(12) United States Patent
Grömminger et al.

(10) Patent No.: US 10,801,067 B2
(45) Date of Patent: *Oct. 13, 2020

(54) DETECTION OF DNA THAT ORIGINATES FROM A SPECIFIC CELL-TYPE AND RELATED METHODS

(71) Applicant: Eurofins LifeCodexx GmbH, Constance (DE)

(72) Inventors: Sebastian Grömminger, Constance (DE); Wera Hofmann, Constance (DE); Hamed Said, Constance (DE); Matthias Sachse, Constance (DE)

(73) Assignee: Eurofins LifeCodexx GmbH, Constance (DE)

( * ) Notice: Subject to any disclaimer, the term of this patent is extended or adjusted under 35 U.S.C. 154(b) by 435 days.

This patent is subject to a terminal disclaimer.

(21) Appl. No.: 15/309,604

(22) PCT Filed: May 8, 2015

(86) PCT No.: PCT/EP2015/060188
§ 371 (c)(1),
(2) Date: Nov. 8, 2016

(87) PCT Pub. No.: WO2015/169947
PCT Pub. Date: Nov. 12, 2015

(65) Prior Publication Data
US 2017/0314073 A1    Nov. 2, 2017

(30) Foreign Application Priority Data

May 9, 2014  (EP) ..................................... 14167769
May 9, 2014  (EP) ..................................... 14167775

(51) Int. Cl.
| | | |
|---|---|---|
| *C12Q 1/68* | (2018.01) | |
| *C12Q 1/6883* | (2018.01) | |
| *C12Q 1/6886* | (2018.01) | |
| *C12Q 1/6827* | (2018.01) | |

(52) U.S. Cl.
CPC ......... *C12Q 1/6883* (2013.01); *C12Q 1/6827* (2013.01); *C12Q 1/6886* (2013.01); *C12Q 2600/154* (2013.01)

(58) Field of Classification Search
None
See application file for complete search history.

(56) References Cited

U.S. PATENT DOCUMENTS

| | | |
|---|---|---|
| 5,804,375 A | 9/1998 | Gelfand et al. |
| 5,994,056 A | 11/1999 | Higuchi |
| 6,200,756 B1 | 3/2001 | Herman et al. |
| 6,258,569 B1 | 7/2001 | Livak et al. |
| 6,331,393 B1 | 12/2001 | Laird et al. |
| 6,727,356 B1 | 4/2004 | Reed et al. |
| 6,929,907 B2 | 8/2005 | Agris |
| 9,822,412 B2 * | 11/2017 | Grömminger ....... C12Q 1/6881 |
| 9,822,413 B2 * | 11/2017 | Grömminger ....... C12Q 1/6881 |
| 10,017,818 B2 * | 7/2018 | Grömminger ....... C12Q 1/6881 |
| 2003/0148278 A1 | 8/2003 | Lauter et al. |
| 2007/0059753 A1 | 3/2007 | Vener et al. |
| 2012/0065076 A1 | 3/2012 | Peters et al. |
| 2012/0252015 A1 | 10/2012 | Hindson et al. |
| 2019/0085402 A1 | 3/2019 | Kassis |

FOREIGN PATENT DOCUMENTS

| | | |
|---|---|---|
| EP | 0 512 334 B1 | 9/1999 |
| EP | 0 706 649 B1 | 1/2001 |
| EP | 0 792 374 B1 | 1/2001 |
| EP | 1524321 A1 | 4/2005 |
| EP | 0 954 608 B1 | 5/2006 |

(Continued)

OTHER PUBLICATIONS

International Search Report and Written Opinion dated Aug. 19, 2015 from International Application No. PCT/EP2015/060188, 16 pages.

Campan et al., "MethyLight", DNA Methylation: Methods and Protocols, 2nd Edition, vol. 507, 2009, pp. 325-337.

Chan et al., "Hypermethylated RASSFIA in Maternal Plasma: A Universal Fetal DNA Marker that Improves the Reliability of Noninvasive Prenatal Diagnosis", Clinical Chemistry, vol. 52, No. 12, 2006, pp. 2211-2218.

(Continued)

*Primary Examiner* — James Martinell
(74) *Attorney, Agent, or Firm* — MH2 Technology Law Group, LLP

(57) ABSTRACT

The present invention relates to methods to detect an amount of DNA that originates from cells of a given type, where the sample comprising such DNA in admixture with DNA that does not originate from such cells. Such methods are based on differential methylation, at certain regions, of the DNA that originates from the given type of cells compared to the admixed DNA. Such methods have particular application in the detection, from a biological fluid from a pregnant female, of cell free DNA that originates from a foetus or the placenta of a foetus, or the detection, from a biological fluid from an individual, of cell free DNA that originates from cells of a tumour. Accordingly, such methods have diagnostic, prognostic and/or predictive utility for detecting an increased risk of an individual suffering from or developing a medical condition such as preeclampsia or cancer, and/or to aid (subsequent) diagnostic, prognostic and/or predictive methods such as the detection of chromosomal trisomy in a foetus, including for twin-pregnancies. The present invention also relates to compositions, kits, computer program products and other aspects that are used in, useful for or related to the practice of such methods.

57 Claims, 6 Drawing Sheets
Specification includes a Sequence Listing.

(56) References Cited

FOREIGN PATENT DOCUMENTS

| | | |
|---|---|---|
| EP | 1 185 695 B1 | 7/2006 |
| EP | 0 543 942 B2 | 11/2006 |
| EP | 1 235 938 B1 | 2/2012 |
| JP | 2005-261354 A | 9/2005 |
| JP | 2007-532100 A | 11/2007 |
| JP | 2013-538565 A | 10/2013 |
| WO | 03/020974 A2 | 3/2003 |
| WO | 03/062441 A1 | 7/2003 |
| WO | 2005/035725 A2 | 4/2005 |
| WO | 2005/098029 A2 | 10/2005 |
| WO | 2005/118852 A2 | 12/2005 |
| WO | 2007/132166 A3 | 11/2007 |
| WO | 2007/132167 A3 | 11/2007 |
| WO | 2007/140417 A2 | 12/2007 |
| WO | 2010/033639 A2 | 3/2010 |
| WO | 2011/018600 A1 | 2/2011 |
| WO | 2011/034631 A1 | 3/2011 |
| WO | 2011/092592 A2 | 8/2011 |
| WO | 2012/149339 A2 | 11/2012 |
| WO | 2013/057568 A1 | 4/2013 |
| WO | 2013/132305 A1 | 9/2013 |
| WO | 2014/011928 A1 | 1/2014 |
| WO | 2014/043763 A1 | 3/2014 |
| WO | 2014/055790 A2 | 4/2014 |
| WO | 2014/168711 A1 | 10/2014 |
| WO | 2015/013885 A1 | 2/2015 |
| WO | 2015/138774 A1 | 9/2015 |
| WO | 2017/220156 A1 | 12/2017 |

OTHER PUBLICATIONS

He et al., "Development of a multplex MethyLight assay for the detection of multigene methylation in human colorectal cancer", Cancer Genetics and Cytogenetics, vol. 202, No. 1, 2010, pp. 1-10.

Nygren et al., "Quantification of Fetal DNA by Use of Methylation-Based DNA Discrimination", Clinical Chemistry, vol. 56, No. 10, 2010, pp. 1627-1635.

Olkhov-Mitsel et al., "Novel Multiplex MethyLight Protocol for Detection of DNA Methylation in Patient Tissues and Bodily Fluids", Scientific Reports, vol. 4, No. 4432, Mar. 21, 2014, pp. 1-8.

Snellenberg et al., "Development of a multiplex methylation-specific PCR as candidate triage test for women with an HPV-positive cervical scrape", BMC Cancer, vol. 12, No. 551, 2012, 9 pages.

Swift-Scanlan et al., "Two-color quantitative multiplex methylation-specific PCR", BioTechniques, vol. 40, No. 2, Feb. 2006, pp. 210-219.

Weisenberger et al., "Analysis of repetitive element DNA methylation by MethyLight", Nucleic Acids Research, vol. 33, No. 21, 2005, pp. 6823-6836.

Weisenberger et al., "DNA methylation analysis by digital bisulfite genomic sequencing and digital MethyLight", Nucleic Acids Research, vol. 36, No. 14, 2008, pp. 4689-4698.

Sperling et al., "Twin pregnancy: the role of ultrasound in management", Acta Obstet Gynecol Scand, 2001, vol. 80, pp. 287-299.

Sorenson et al., "Soluble Normal and Mutated DNA Sequences from Single-Copy Genes in Human Blood", Cancer Epidemiology, Biomarkers & Prevention, Jan./Feb. 1994, vol. 3, pp. 67-71.

Vasioukhin et al., "Point mutations of the N-ras gene in the blood plasma DNA of patients with myelodysplastic syndrome or acute myelogenous leukaemia", British Journal of Haematology, 1994, vol. 86, pp. 774-779.

Lo et al., "Presence of fetal DNA in maternal plasma and serum", The Lancet, Aug. 16, 1997, vol. 350, pp. 485-487.

Muller et al., "Methylated DNA as a possible screening marker for neoplastic disease in several body fluids", Expert Rev. Mol. Diagn., 2003, vol. 3(4), pp. 443-458.

Lo et al., "Quantitative Analysis of the Bidirectional Fetomaternal Transfer of Nucleated Cells and Plasma DNA", Clinical Chemistry, 2000, vol. 46:9, pp. 1301-1309.

Smid et al., "Correlation of fetal DNA levels in maternal plasma with Doppler status in pathological pregnancies", Prenat Diag, 2006, pp. 785-790.

Lo et al., "Rapid Clearance of Fetal DNA from Maternal Plasma", Am. J. Hum. Genet, 1999, vol. 64, pp. 218-224.

Kawai et al., "Methylation profiles of genomic DNA of mouse developmental brain detected by restriction landmark genomic scanning (RLGS) method", Nucleic Acids Research, 1993, vol. 21:24, pp. 5604-5608.

Masuzaki et al., "Detection of cell free placental DNA in maternal plasma: direct evidence from three cases of confined placental mosaicism", J. Med. Genet, 2004, vol. 41, pp. 289-292.

Flori et al., "Circulating cell-free fetal DNA in maternal serum appears to originate from cyto- and syncytio-trophoblastic cells. Case Report", Human Reproduction, Jan. 29, 2004, vol. 19:3, pp. 723-724.

Chim et al., "Detection of the placental epigenetic signature of the maspin gene in maternal plasma", Proc. Natl. Acad. Sci. USA, Oct. 11, 2005, vol. 102:41, pp. 14753-14758.

Chiu et al., "Hypermethylation of RASSF1A in Human and Rhesus Placentas", The American Journal of Pathology, Mar. 2007, vol. 170:3, pp. 941-950.

Old et al., "Candidate epigenetic biomarkders for non-invasive prenatal diagnosis of Down syndrome", Reproductive BioMedicine Online, Jun. 21, 2007, vol. 15:2, pp. 227-235.

Chim et al., "Systematic Search for Placental DNA-Methylation Markers on Chromosome 21: Toward a Maternal Plasma-Based Epigenetic Test for Fetal Trisomy 21", Clinical Chemistry, 2008, vol. 54:3, pp. 500-511.

Lo et al., "Prenatal Diagnosis of Fetal RhD Status by Molecular Analysis of Maternal Plasma", The New England Journal of Medicine, Dec. 10, 1998, vol. 339, pp. 1734-1738.

Go et al., "Non-invasive aneuploidy detection using free fetal DNA and RNA in maternal plasma: recent progress and future possibilities", Human Reproduction update, 2011, vol. 17:3, pp. 372-382.

Lo et al., "Quantitative Analysis of Fetal DNA in Maternal Plasma and Serum: Implications for Noninvasive Prenatal Diagnosis", Am. J. Hum. Genet., 1998, vol. 62, pp. 768-775.

Lo et al., "Quantitative Abnormalities of Fetal DNA in Maternal Serum in Preeclampsia", Clinical Chemistry, 1999, vol. 45:2, pp. 184-188.

Yu et al., "Quantification of Maternal Serum Cell-Free Fetal DNA in Early-Onset Preeclampsia", Int. J. Mol. Sci, Apr. 8, 2013, vol. 4, pp. 7571-7582.

Hahn et al., "Cell-Free Nucleic Acids as Potential Markers for Preeclampsia", Placenta, 2011, vol. 32, pp. S17-S20.

Li et al., "Hypermethylation of multiple tumor-related genes associated with DMNT3b upregulation served as a biomarker for early diagnosis of esophageal squamous cell carcinoma", Epigenetics, Mar. 2011, vol. 6:3, pp. 307-316.

Ha et al., "Elevated Levels of Cell-Free Circulating DNA in Patients with Acute Dengue Virus Infection", PLoS One, Oct. 7, 2011, vol. 6:10, e25969, pp. 1-7.

Outinen et al., "Plasma Cell-Free DNA Levels Are Elevated in Acute Puumula Hantavirus Infection", PLoS One, Feb. 7, 2012, vol. 7:2, e31455, pp. 1-7.

Forsblom et al., "High Cell-Free DNA Predicts Fatal Outcome among *Staphylococcus aureus* Bacteraemia Patients with Intensive Care Unit Treatment", PloS One, Feb. 10, 2014, vol. 9:2, e87741, pp. 1-9.

Chan et al., "Size Distributions of Maternal and Fetal DNA in Maternal Plasma", Clinical Chemistry, 2004, vol. 50:1, pp. 88-92.

Kimura et al., "Fragment Size Analysis of Free Fetal DNA in Maternal Plasma Using Y-STR Loci and SRY Gene Amplification", Nagoya J. Med. Sci., 2011, vol. 73, pp. 129-135.

Lo et al., "Maternal Plasma DNA Sequencing Reveals the Genome-Wide Genetic and Mutational Profile of the Fetus", Science Translational Medicine, Dec. 8, 2010, vol. 2:61, 61ra91 pp. 1-14.

Elshimali et al., "The Clinical Utilization of Circulating Cell Free DNA (CCFDNA) in Blood of Cancer Patients", International Journal of Molecular Sciences, 2013, vol. 14, pp. 18925-18958.

Sacha Zeerleder, "The struggle to detect circulating DNA", Critical Care, 2006, vol. 10:142, pp. 1-3.

(56) References Cited

OTHER PUBLICATIONS

Kirsch et al., "An Improved Method for the Isolation of Free-Circulating Plasma DNA and Cell-Free DNA from Other Body Fluids", Ann. N.Y. Acad. Sci., 2008, vol. 1137, pp. 135-139.
Struble et al., "Fetal Fraction Estimate in Twin Pregnancies Using Directed Cell-Free DNA Analysis", Fetal Diagnosis and Therapy, Dec. 7, 2013, pp. 1-5.
Gauthier et al., "Blood Clearance Kinetics and Liver Uptake of Mononucleosomes in Mice", The Journal of Immunology, 1996, vol. 156, pp. 1151-1156.
Lo et al., "Quantitative Analysis of Aberrant p16 Methylation Using Real-Time Quantitative Methylation-specific Polymerase Chain Reaction", Cancer Research, Aug. 15, 1999, vol. 59, pp. 3899-3903.
Birch et al., "Accurate and Robust Quantification of Circulating Fetal and Total DNA in Maternal Plasma from 5-41 Weeks of Gestation", Clinical Chemistry, 2005, vol. 51:2, pp. 312-320.
Papageorgiou et al., "Fetal-specific DNA methylation ratio permits non-invasive prenatal diagnosis of trisomy 21", Nat. Med., Apr. 7, 2011, vol. 17:4, pp. 1-13.
Tong et al., "Technical concerns about immunoprecipitation of methylated fetal DNA for noninvasive trisomy 21 diagnosis", Nature Medicine, Sep. 2012, vol. 18:9, pp. 1327-1328.
Hindson et al., "High-Throughput Droplet Digital PCR System for Absolute Quantitation of DNA Copy Number", Anal. Chem., 2011, vol. 83, pp. 8604-8610.
White et al., "Evaluation of a Novel Assay for Detection of the Fetal Marker RASSF1A: Facilitating Improved Diagnostic Reliability of Noninvasive Prenatal Diagnosis", PLoS One, Sep. 14, 2012, vol. 7:9, e45073 pp. 1-5.
Qu et al., "Noninvasive Prenatal Determination of Twin Zygosity by Maternal Plasma DNA Analysis", Clinical Chemistry, 2013, vol. 59:2, pp. 427-435.
Lim et al., "Disease specific characteristics of fetal epigenetic markers for non-invasive prenatal testing of trisomy 21", BMC Medical Genomics, 2014, vol. 7:1, pp. 1-11.
Poon et al., "Differential DNA Methylation between Fetus and Mother as a Strategy for Detecting Fetal DNA in Maternal Plasma", Clinical Chemistry, 2002, vol. 48:1, pp. 35-41.
Yegnasubramanian et al., "Combination of methylated-DNA precipitation and methylation-sensitive restriction enzymes (COMPARE-MS) for the rapid, sensitive and quantitative detection of DNA methylation", Nucleic Acids Research, 2006, vol. 34:3, e19 pp. 1-14.
Papantoniou et al., "RASSF1A in maternal plasma as a molecular marker of preeclampsia", Prenatal Diagnosis, 2013, vol. 33, pp. 682-687.
Zeybek et al., "Clinical evaluations of cell-free fetal DNA quantities in pre-eclamptic pregnancies", J. Obstet Gynaecol Res., Mar. 2013, vol. 39:3, pp. 632-640.
Jakobsen et al., "Identifying mild and severe preeclampsia in asymptomatic pregnant women by levels of cell-free fetal DNA", Transfusion, Sep. 2013, vol. 53, pp. 1956-1964.
Chen et al., "Chimerism in Monochorionic Dizygotic Twins: Case Study and Review", Am. J. Med. Genet. Part A, May 22, 2013, vol. 161A, pp. 1817-1824.
Chan et al., "Hypermethylated RASSF1A in Maternal Plasma: A Universal Fetal DNA Marker that Improves the Reliability of Noninvasive Prenatal Diagnosis", Clinical Chemistry, 2006, vol. 52:12, pp. 2211-2218.

Stumm et al., "Diagnostice accuracy of random massively parallel sequencing for non-invasive prenatal detection of common autosomal aneuploidies: a collaborative study in Europe", Prenatal Diagnosis, 2014, vol. 34, pp. 185-191.
Leung et al., "Noninvasive twin zygosity assessment and aneuploidy detection by maternal plasma DNA sequencing", Prenatal Diagnosis, 2013, vol. 33, pp. 675-681.
Russian Office Action dated Dec. 27, 2018 for Russian Patent Application No. 2016147914, 13 pages with English translation.
Papageorgiou et al., "Non-invasive prenatal diagnosis of aneuploidies: new technologies and clinical applications", Genome Medicine, 2012, vol. 4, No. 5, 12 pages.
Search Report and Written Opinion dated Nov. 16, 2017 from Singaporean Application No. 11201608993R, 11 pages.
Tong et al., "Noninvasive Prenatal Detection of Fetal Trisomy 18 by Epigenetic Allelic Ratio Analysis in Maternal Plasma: Theoretical and Empirical Considerations", Clinical Chemistry, 2006, vol. 52, No. 12, pp. 2194-2202.
Papageorgiou et al., "Sites of Differential DNA Methylation between Placenta and Peripheral Blood", The American Journal of Pathology, May 2009, vol. 174, No. 5, pp. 1609-1618.
International Search Report and Written Opinion dated Feb. 3, 2017 from International Application No. PCT/EP2016/077065, 14 pages.
European Search Report and Written Opinion dated Mar. 18, 2016 from European Application No. 15193966, 9 pages.
Norwitz et al., "Noninvasive Prenatal Testing: The Future is Now", Reviews in Obstetrics & Gynecology, 2013, vol. 6, No. 2, pp. 48-62.
Lim et al., "Non-Invasive Epigenetic Detection of Fetal Trisomy 21 in First Trimester Maternal Plasma", PLoS One, Nov. 2011, vol. 6, No. 11, e27709, 8 pages.
Tong et al., "Noninvasive Prenatal Detection of Trisomy 21 by an Epigenetic-Genetic Chromosome-Dosage Approach", Clinical Chemistry, 2010, vol. 56, No. 1, pp. 90-98.
Tsaliki et al., "MeDIP real-time qPCR of maternal peripheral blood reliably identifies trisomy 21", Prenatal Diagnosis, 2012, vol. 32, pp. 996-1001.
Lim et al., "Non-invasive detection of fetal trisomy 21 using fetal epigenetic biomarkers with a high CpG density", Clin Chem Lab Med, 2014, vol. 52, No. 5, pp. 641-647.
Chim et al., "Potentail application of fetal epigenetic markers on the non-invasive prenatal detection of chromosomal abnormality", Clin Chem Lab Med, 2014, vol. 52, No. 5, pp. 585-588.
Yin et al., "Placental methylation markers in normal and trisomy 21 tissues", Prenatal Diagnosis, 2014, vol. 34, pp. 63-70.
Tong et al., "Detection of Restriciton Enzyme-Digested Target DNA by PCR Amplification Using a Stem-Loop Primer: Application to the Detection of Hypomethylated Fetal DNA in Maternal Plasma", Clinical Chemistry, 2007, vol. 53, No. 11, pp. 1906-1914.
Ragione et al., "Differential DNA Methylation as a Tool for Non-invasive Prenatal Diagnosis (NIPD) of X Chromosome Aneuploidies", Journal of Molecular Diagnostics, Nov. 2010, vol. 12, No. 6, pp. 797-807.
Hatt et al., "Microarray-Based Analysis of Methylation Status of CpGs in Placental DNA and Maternal Blood DNA—Potential New Epigenetic for Cell Free Fetal DNA-Based Diagnosis", PLoS One, Jul. 31, 2015, vol. 10, No. 7, e0128918, 12 Pages.
Japanese Office Action dated Mar. 19, 2019 for Japanese Patent Application No. 2016-566621, 13 pages with English translation.
Tong et al., "Diagnostic developments involving cell-free (circulating) nucleic acids", Clinical Chimica Acta, 2006, vol. 363, pp. 187-196.
Office Action dated Jun. 30, 2020 from Indian Patent Application No. 201617040933 (Controller, Dr. Jyoti), 8 pages.

* cited by examiner

DETECTION OF DNA THAT ORIGINATES FROM A SPECIFIC CELL-TYPE AND RELATED METHODS

CROSS-REFERENCE TO RELATED APPLICATIONS

This application is a U.S. National Stage application of PCT/EP2015/060188 filed 8 May 2015, which claims priority to European Application No. 14167769.0 filed 9 May 2014 and European Application No. 14167775.7 filed 9 May 2014, the entire disclosures of which are hereby incorporated by reference in their entireties.

SEQUENCE LISTING

The instant application contains a Sequence Listing which has been submitted electronically in ASCII format and is hereby incorporated by reference in its entirety. Said ASCII copy, created on Jul. 17, 2017, is named DFMP-115-US_S-L.TXT and is 1,392,495 bytes in size.

The present invention relates to methods to detect an amount of DNA that originates from cells of a given type, where the sample comprising such DNA in admixture with DNA that does not originate from such cells. Such methods are based on differential methylation, at certain regions, of the DNA that originates from the given type of cells compared to the admixed DNA. Such methods have particular application in the detection, from a biological fluid from a pregnant female, of cell free DNA that originates from a foetus or the placenta of a foetus, or the detection, from a biological fluid from an individual, of cell free DNA that originates from cells of a tumour. Accordingly, such methods have diagnostic, prognostic and/or predictive utility for detecting an increased risk of an individual suffering from or developing a medical condition such as preeclampsia or cancer, and/or to aid (subsequent) diagnostic, prognostic and/or predictive methods such as the detection of chromosomal trisomy in a foetus, including for twin-pregnancies. The present invention also relates to compositions, kits, computer program products and other aspects that are used in, useful for or related to the practice of such methods.

Cell-free DNA (cfDNA), especially that found in plasma or serum, has been the subject of considerable research over the past decade. Despite the original finding of circulating cell-free nucleic acids in the bloodstream being described by Mandel and Metais as early as 1948 (Mandel and Metais 1948, CR Acad Sci Paris 142:241), it took until the mid 1990s for proof that tumours shed DNA into the circulatory system (Sorenson et al 1994, Cancer Epidemiol Biomarkers Prev 3:67; Vassioukhin et al 1994, Br J Haematol 86:774), and until 1997 for the discovery of cfDNA originating from a foetus in the circulatory system of the mother (Lo et al 1997, Lancet 350:485).

Among other forms of characteristics shown by circulating cfDNA, numerous studies have described the presence of methylated circulating cfDNA in the plasma/serum and other body fluids of patients with various types of malignancy and the absence of methylated DNA in normal control patients (for review see Muller and Widschwendter 2003, Expert Rev Mol Diagn 3:443). Although other characteristics of circulating cfDNA exist and are important for diagnostic, prognostic or predictive studies (for example, sequence mutations and micro duplications/deletions), such methylation-based epigenetic characteristics have become an increasingly important source of serologic markers for diagnosis, risk assessment and even for therapy monitoring during follow-up of cancer patients.

Likewise, the use of differences in foetal cfDNA present in the maternal circulation has been the main goal for the development of non-invasive prenatal tests (NIPT). Foetal cfDNA is derived from embryonic cell degradation in maternal peripheral blood (Lo et al 2000, Clin Chem 46:1301) or from apoptotic placental cells (Smid et al 2006, Prenat Diagn 26:785). It has been demonstrated that foetal cfDNA from maternal plasma is cleared immediately (within a few hours) after pregnancy (Lo et al 1999, Am J Hum Genet 64:218). This finding is of great importance, since the presence of foetal cfDNA from previous pregnancies would otherwise interfere with the correct interpretation of subsequent pregnancies.

It is believed that 60% of tissue-specific differentially methylated regions are methylated in embryonic cells, while during the differentiation of embryonic tissues to adult tissues, they undergo de-methylation (Kawai et al 1993, Nucleic Acids Res 21:5604). Based on the evidence that foetal cfDNA in maternal plasma is of placental origin, epigenetic differences between maternal peripheral (whole) blood and placental DNA have been used to detect a hypomethylated gene sequence (maspin/SERPINB5) in maternal plasma derived from the foetus (Masuzaki et al 2004, J Med Genet 41:289; Fiori et al 2004, Hum Reprod 19:723; Chim et al 2005, Proc Natl Acad Sci USA 102: 14753). Subsequently, a number of additional differential foetal methylation-based epigenetic molecular markers have been described, including the RASSF1A gene on chromosome 3, as well as a marker on chromosome 21 (Chiu et al 2007, Am J Pathol 170:941; Old et al 2007, Reprod Biomed Online 15:22; Chim et al 2008, Clin Chem 54:500) and others including T-box 3 (TBX3) (Nygren et al 2010, Clin Chem 65:10; WO 2010/033639; WO 2011/034631).

Various methodologies exist for NIPT based on the analysis of foetal cfDNA. For example, foetal sex determination using eg DYS14 (Lo et al 1997; Lancet 350:485), as well as foetal Rhesus D found in maternal circulation in pregnancies in which the mother was Rhesus D negative (Lo 1998, N Eng J Med 339:1734). Also, and of particular relevance, are those using next generation sequencing (NGS) technologies on cfDNA isolated from maternal plasma with the primary aim of detecting the most common chromosomal aneuploidies as commercially available tests (for example, those using random massively parallel sequencing: www.sequenom.com; www.lifecodexx.com; www.verinata.com). Other technologies include targeted approaches, the aim of which is to enrich specific genomic regions of interest before sequencing to reduce the number of sequence tags needed to perform a reliable statistical analysis (eg www.ariosadx.com or www.natera.com), polymorphism analysis or digital PCR (for review, see Go et al 2011, Human Reprod Update 17:372). However, regardless of the specific technology used, current applications of NIPT rely on the qualitative detection of foetal cfDNA to determine the genetic makeup of the foetus. Such an approach leads to an analytic dilemma, because test results from samples that do not contain any or sufficient foetal DNA or are contaminated with maternal cellular DNA can be misleading. The analogous issue arises in diagnostic, prognostic or predicative tests of tumour derived cfDNA from the circulatory system: the quality of the test result often is dependent on the presence of sufficient, or sufficiently pure, tumour-derived cfDNA in the total DNA from the sample.

The quantitative determination of an amount of DNA originating from such a cell type may, in itself, form a critical part of a diagnostic, prognostic or predicative test. For example, even though studies have demonstrated that the amount of foetal DNA released in maternal circulation increases with pregnancy progression (Lo et al 1998, Am J Hum Genet 62:768), preeclampsia, which results from abnormal trophoblast invasion, is also associated with further elevated foetal cfDNA levels in the maternal circulation. Lo et al (1999, Clin Chem 45:184) demonstrated a fivefold increase in circulating foetal cfDNA concentrations in the plasma of symptomatic preeclamptic women compared with control pregnant subjects, and further studies have investigated if elevated serum foetal cfDNA developed into early-onset preeclampsia (Yu et al 2013, Int J Mol Sci 14:7571), and the potential of cfDNA as a marker for preeclampsia is being increasingly studied (for review, see Hahn et al 2011, Placenta 32(Supl):S17). An increased level of circulating cfDNA and/or the level of methylation of such DNA at certain regions is also associated with other medical conditions. For example, hypermethylation of serum cfDNA was found to be common in patients suffering from oesophageal squamous cell carcinoma, and diagnostic accuracy was increased when methylation of multiple genes (RAR-beta, DAPK, CDH1, p16 and RASSF1A) were analysed in combination (Li et al 2011, Epigenetics 6:307). Elevated levels of circulating cfDNA have been reported in patients with acute dengue virus infection (Ha et al 2011, PLoS One 6(10):e25969), in acute Puumala hantavirus infection Outinen et al 2012, PLoS One 7(2):e31455) and high cfDNA has been reported to predict fatal outcome among *Staphylococcus aureus* bacteraemia patients with intensive care unit treatment (Forsblom et al 2014, PLoS One 10; 9(2): e87741).

It is known that foetal cfDNA present in the maternal circulatory system and tumour derived circulating cfDNA is degraded. For example, studies characterising cfDNA in maternal plasma have found that the size of foetal DNA fragments were estimated to be <0.3 kb, whereas that of maternal DNA was >1 kb (Chan et al 2004, Clin Chem 50:88). Follow-up studies have demonstrated that the release of foetal DNA is due to the apoptosis of no more than three nucleosomal complexes, it has also been shown that the average foetal fragment size is 286+/−28 bp with a maximum foetal cfDNA fragment size ranging from 219 to 313 bp (Kimura et al 2011, Nagoya J Med Sci 73:129), and another study has reported that the most significant difference in the size distribution between foetal and total DNA is that foetal DNA exhibits a reduction in a 166-bp peak size and a relative prominence of the 143-bp peak; the latter likely corresponding to the trimming of a ~20-bp linker fragment from a nucleosome to its core particle of ~146 bp (Lo et al 2010, Sci Transl Med 2:61).

In cancer patients, circulating cfDNA in plasma is protein-bound (nucleosomal) DNA and has a short half-life (10 to 15 min) which is removed mainly by the liver (Elshimali et al 2013, Int J Mol Sci 14:18925). Accumulation of cfDNA in the circulation of cancer patients can result from an excessive release of DNA caused by massive cell death, inefficient removal of the dead cells, or a combination of both (Zeerleder 2006, Crit Care 10:142). It should be noted that although cancer patients requiring renal support have higher values of circulating cfDNA, the renal elimination is not the main mechanism of its clearance. The plasma levels of circulating cfDNA do not seem to be dramatically altered in chronic kidney disease, peritoneal dialysis or hemodialysis (Kirsch et al 2008, Ann NY Acad Sci 1137:135).

Although the nucleosome is a very stable protein-DNA complex, it is not static and has been shown to undergo a number of different structural re-arrangements including nucleosome sliding and DNA site exposure. Depending on the context, nucleosomes can inhibit or facilitate transcription factor binding. Also, packaging of DNA into nucleosomes varies depending on the cell cycle stage and by local DNA region (Russell 2010, 'iGenetics". 3rd ed. San Francisco: Pearson Benjamin Cummings, pp 24-27). The degree to which chromatin is condensed is associated with a certain transcriptional state. Unpackaged or loose chromatin is more transcriptionally active than tightly packaged chromatin because it is more accessible to transcriptional machinery. By remodelling chromatin structure and changing the density of DNA packaging, gene expression can thus be modulated. Accordingly, and without being bound by theory, the qualitative and/or quantitative level of chromatin packing of a given region of cfDNA may affect its stability, and hence the amount detected in the circulatory system at any given time, Correspondingly, differences between the level of chromatin packing between different DNA regions (for example, due to differences in each regions state of transcription) may influence the relative quantities of DNA from each of these regions when detected as cfDNA, particularly as two studies have investigated in more detail the kinetics of, and reported the rapid, clearance of cfDNA from the circulatory system (Gauthier et al 1996, J Immunol 156: 1151; Lo et al 1999, Am J Hum Genet 64:218).

Various prior art methods have been described to detect, and quantify, cfDNA from a specific cell type. Quantitative analysis of aberrant p16 methylation was described using probe-based real-time quantitative PCR (Lo et al 1999, Cancer res 59:3899). Analogously, differences in the methylation of the placental maspin gene found in material plasma has been described, and the methylation signature further analysed using MALDI-TOF mass-spectrometry (Chim et al 2005). Total cfDNA and that from male foetuses (only) were accurately and robustly quantified in materal plasma from 5 to 41 weeks of gestation using a Y-chromosome specific marker (SRY) (Birch et al 2005, Clin Chem 51:2). Hypermethylation of RASSF1A has been proposed as a universal foetal DNA marker to improve the reliability of NIPT, and was studied in a duplex probe-based real-time PCR reaction compared to the non-differentially methylated region on the beta-actin gene (Chan et al 2006, Clin Chem 52:12). A complex method of quantification has been described (Nygren et al 2010; Clin Chem 56:10; WO 2010/033639; WO 2011/034631): starting from a 13-plex competition-PCR reaction (5 differentially methylated regions (DMRs) including TBX3, 3 regions on different genes for total DNA quantification, 3 for quantification of chromosome Y and 2 for restriction enzyme controls), such a complex reaction is subsequently processed for singe-base extension reactions and finally mass-spectrometry is subsequently conducted to both quantify and identify each of the single alleles my mass differences. Also using a complex process starting from methylated DNA immunoprecipitation, and based on SYBR green based quantitative PCR of a plurality of DMRs, has been claimed to be able to accurately quantitate foetal cfDNA and use such quantitation from eg chromosome 21 DMRs, to prenatally diagnose trisomies (Papageorgiou et al 2011, Nat Med 4:510; WO 2012/092592); although technical concerns about such an approach to diagnose trisomies have been raised (Tong et al 2012; Nat Med 18:1327). High-throughput droplet digital PCR (ddPCR) has been described for absolute quantification of DNA copy number from normal and tumorous breast tissues, and also total and foetal cfDNA in maternal plasma using duplex probe-based quantitative PCR of RASSF1/

RNaseP and RASSF1/beta-actin (Hindson et al 2011, Anal Chem 83:8604). Separate SYBR green quantitative PCR reactions of RASSF1A, SRY and DYS14 have been evaluated as an assay to detect RASSf1A to facilitate improved diagnostic reliability of NIPT (White et al 2012; PLOS ONE 7(9):e45073). However, generally considered as the "gold standard" for the quantitative measurement of foetal cfDNA against which other assays are often compared, remains the quantification of Y chromosome-specific genes (eg SFY) of male foetuses eg, as used by Yu and co-workers to determine whether the increased foetal cfDNA in maternal serum level of gravitas developed into early-onset preeclampsia (Yu et al 2013, Int J Mol Sci 14:7571).

Others have suggested that epigenetic biomarkers can be exploited for NIPT of trisomy 21, such as by quantifying a chromosome 21-derived sequence in epigenetically identified foetal cfDNA, relative to a reference sequence derived from another autosome or sex chromosome (Old et al 2007; RBMOnline 15:227); where the comparative reference sequence may be either a SNP allele-specific region or by direct comparison with a foetal- or placental-specific methylation marker on the reference chromosome (Tong et al 2006; ClinChem 52:2194; WO2007/132166; WO2007/132167; Chim et al 2008; ClinChem 54:500; Papageorgio et al 2009; AmJPath 174:1609).

Accordingly there is a need, from one or more of the above or perspectives, for improved methods to detect, preferably quantitatively, an amount of a species of DNA that originates from a particular cell type, such as a tumour-, foetal- or a placental cell, in particular to so detect cfDNA eg from the circulatory system of an individual. In particular, there is also a need, from one or more of the above or perspectives, for improved methods to detect, indicate or diagnose the presence of an abnormality in such a species of DNA, for example a chromosomal abnormality such as a chromosomal aneuploidy in a foetus.

Accordingly, it is an object of the present invention to provide alternative, improved, simpler, cheaper and/or integrated means or methods that address one or more of these or other problems. Such an object underlying the present invention is solved by the subject matter as disclosed or defined anywhere herein, for example by the subject matter of the attached claims.

Generally, and by way of brief description, the main aspects of the present invention can be described as follows:

In a first aspect, and as may be further described, defined, claimed or otherwise disclosed herein, the invention relates to a method for detecting in a sample from an individual an amount of a species of DNA originating from cells of a given type, which sample comprises said species of DNA in admixture with differently methylated DNA not originating from cells of said type; said method comprising the steps:

(a) treating the DNA present in said sample with a reagent that differentially modifies methylated and non-methylated DNA;

(b) detecting in said sample the presence of methylation in said species of DNA at one or more differently methylated region(s) (DMR(s)) that is(are) differently methylated between said species of DNA and the DNA not originating from cells of said type, the modification of DNA of such DMR by said reagent is sensitive to methylation of DNA, wherein the presence of methylated DNA at said DMR indicates the presence of said amount of species of DNA in said sample and the absence of methylated DNA at said DMR indicates the absence of said species of DNA in said sample; and (c) detecting an amount of total DNA present in said sample using at least one other region that is not differently methylated between said species of DNA and the DNA not originating from cells of said type, the modification of which regions(s) by said reagent is insensitive to methylation of DNA, wherein, said other region is located between about 20 bp and about 20 kb upstream or downstream of said DMR.

In a second aspect, and as may be further described, defined, claimed or otherwise disclosed herein, the invention relates to a method for detecting in a sample from an individual an amount of a species of DNA originating from cells of a given type, which sample comprises said species of DNA in admixture with differently methylated DNA not originating from cells of said type; said method comprising the steps (a) treating the DNA present in said sample with a reagent that differentially modifies methylated and non-methylated DNA;

(b) detecting in said sample the presence of methylation in said species of DNA at two or more differently methylated regions (DMRs) that are differently methylated between said species of DNA and the DNA not originating from cells of said type, the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample; and (c) detecting an amount of total DNA present in said sample using at least one other region that is not differently methylated between said species of DNA and the DNA not originating from cells of said type, the modification of which region(s) by said reagent is insensitive to methylation of DNA, wherein, said detection in step (b) and said detection in step (c) are made using the same aliquot of DNA of said sample, and in the same vessel, and effectively simultaneously for such DMRs and other region(s), and using: (x) the same detectable label(s) for each of said DMRs; and (y) a different detectable label(s) for said other region(s).

In a further aspect, and as may be further described, defined, claimed or otherwise disclosed herein, the invention relates to a method for detecting a chromosomal aneuploidy in a foetus carried by a pregnant female, said method comprising the steps:

(A) Determining, using a method of the first or second aspect of the present invention, in a sample taken from said pregnant female the amount of a first species of DNA that originates from cells of a foetus and/or the placenta of a foetus, wherein said first species of DNA is located on a chromosome relevant to the chromosomal aneuploidy or within a section of a chromosome relevant to the chromosomal aneuploidy, and wherein said first species of DNA that originates from cells of a foetus and/or the placenta of a foetus is distinguished from its counterpart of maternal origin in the sample due to differential DNA methylation;

(B) Determining, using a method of the first or second aspect of the present invention, the amount of a second species of DNA that originates from cells of a foetus and/or the placenta of a foetus in said sample, wherein said second species of DNA is located on a reference chromosome, and wherein said second species of DNA that originates from cells of a foetus and/or the placenta of a foetus is distinguished from its counterpart of maternal origin in the sample due to differential DNA methylation;

(C) determining the relative amount, preferable the ratio, of the amounts from (A) and (B); and (D) comparing said relative amount or ratio with a threshold and/or reference distribution of amount(s) or ratio(s), wherein: a relative amount or ratio that is higher or lower than said threshold and/or reference distribution of amount(s) or ratio(s) indicates the presence of the chromosomal aneuploidy in the foetus.

In another aspect, the invention also relates to a method for detecting an increased risk of an individual suffering from or developing a medical condition, said method comprising the steps:

(i) conducting a method of the first or second aspect of the invention, wherein each of the detection steps comprises quantitative detection; and (ii) comparing the amount of said species of DNA detected with a threshold amount and/or a reference distribution of amounts, wherein an increase in, or outlying of, the amount of said species of DNA indicates an increased risk of the individual suffering from or developing said medical condition. In other aspects, the invention also relates to a composition, a kit and a computer program product, in each case as may be described, defined, claimed or otherwise disclosed herein, for use within or in connection with a method of the invention.

The figures show:

Figure 8:
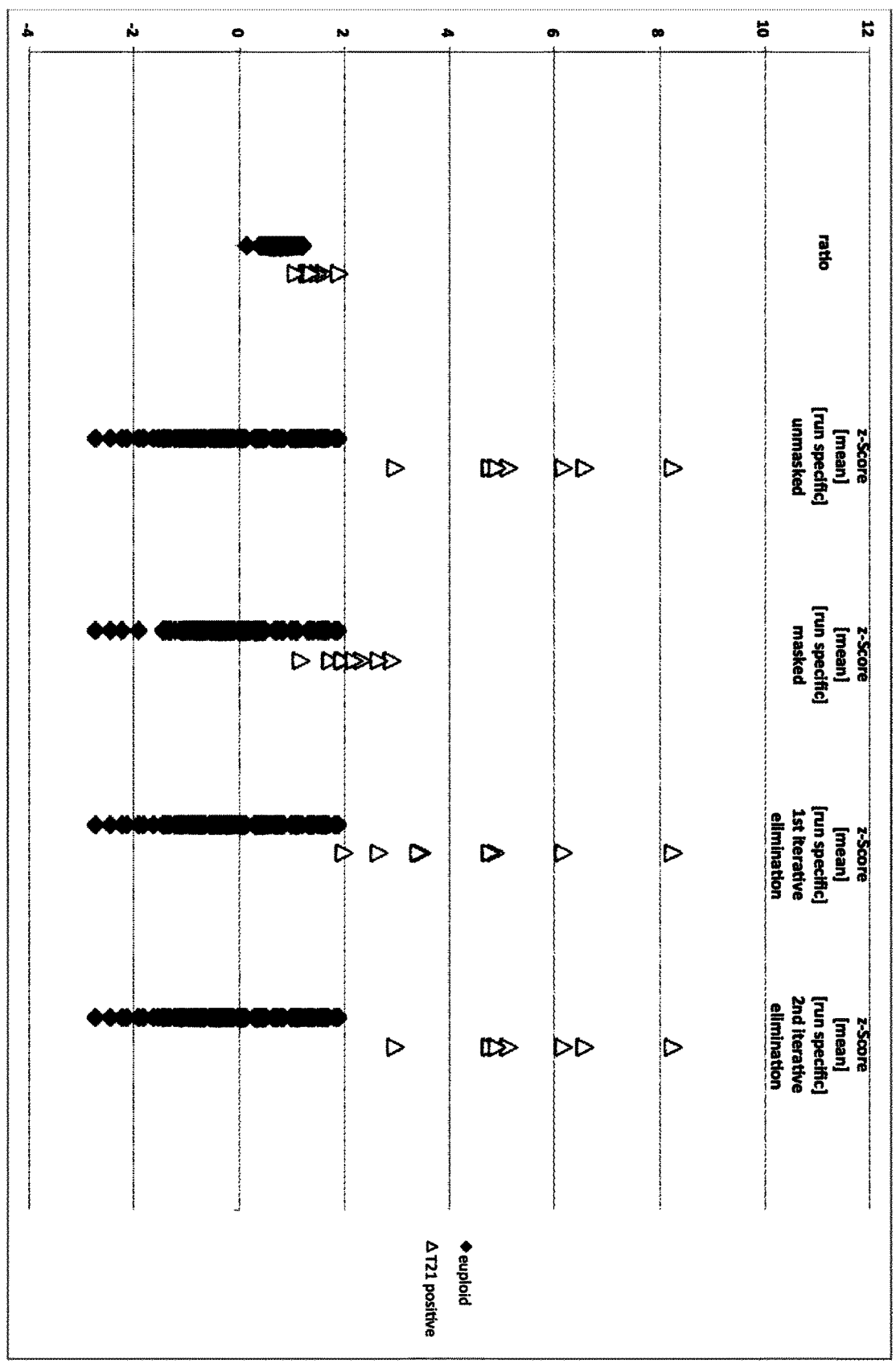

FIG. 8 depicts the results of a z-score analysis of the ratio of foetal chromosome 21 to foetal chromosome 12 of 138 cfDNA samples taken from pregnant females which include 8 such samples from pregnancies carrying a foetus with a chromosome 21 trisomy.

The present invention, and particular non-limiting aspects and/or embodiments thereof, can be described in more detail as follows:

In a first aspect, the invention relates to a method for detecting in a sample from an individual an amount of a species of DNA originating from cells of a given type, which sample comprises said species of DNA in admixture with differently methylated DNA not originating from cells of said type; said method comprising the steps:

(a) treating the DNA present in said sample with a reagent that differentially modifies methylated and non-methylated DNA;

(b) detecting in said sample the presence of methylation in said species of DNA at one or more differentially methylated region(s) (DMR(s)) that is(are) differently methylated between said species of DNA and the DNA not originating from cells of said type, the modification of DNA of such DMR by said reagent is sensitive to methylation of DNA, wherein the presence of methylated DNA at said DMR indicates the presence of said amount of species of DNA in said sample and the absence of methylated DNA at said DMR indicates the absence of said species of DNA in said sample; and (c) detecting an amount of total DNA present in said sample using at least one other region that is not differently methylated between said species of DNA and the DNA not originating from cells of said type, the modification of which regions(s) by said reagent is insensitive to methylation of DNA, wherein, said other region is located between about 20 bp and about 20 kb upstream or downstream of said DMR.

In a second aspect, the invention relates to a method for detecting in a sample from an individual an amount of a species of DNA originating from cells of a given type, which sample comprises said species of DNA in admixture with differently methylated DNA not originating from cells of said type; said method comprising the steps:

(a) treating the DNA present in said sample with a reagent that differentially modifies methylated and non-methylated DNA;

(b) detecting in said sample the presence of methylation in said species of DNA at two or more differentially methylated regions (DMRs) that are differently methylated between said species of DNA and the DNA not originating from cells of said type, the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample; and (c) detecting an amount of total DNA present in said sample using at least one other region that is not differently methylated between said species of DNA and the DNA not originating from cells of said type, the modification of which region(s) by said reagent is insensitive to methylation of DNA, wherein, said detection in step (b) and said detection in step (c) are made using the same aliquot of DNA of said sample, and in the same vessel, and effectively simultaneously for such DMRs and other region(s), and using: (x) the same detectable labels(s) for each of said DMRs; and (y) a different detectable label(s) for said other region(s). Terms as set forth herein are generally to be understood by their common meaning unless indicated otherwise. Where the term "comprising" or "comprising of" is used herein, it does not exclude other elements. For the purposes of the present invention, the term "consisting of" is considered to be a particular embodiment of the term "comprising of". If hereinafter a group is defined to comprise at least a certain number of embodiments, this is also to be understood to disclose a group that consists of all and/or only of these embodiments. Where used herein, "and/or" is to be taken as specific disclosure of each of the two specified features or components with or without the other. For example "A and/or B" is to be taken as specific disclosure of each of (i) A, (ii) B and (iii) A and B, just as if each is set out individually herein. In the context of the present invention, the terms "about" and "approximately" denote an interval of accuracy that the person skilled in the art will understand to still ensure the technical effect of the feature in question. The term typically indicates deviation from the indicated numerical value by ±20%, ±15%, ±10%, and for example ±5%. As will be appreciated by the person of ordinary skill, the specific such deviation for a numerical value for a given technical effect will depend on the nature of the technical effect. For example, a natural or biological technical effect may generally have a larger such deviation than one for a man-made or engineering technical effect. Where an indefinite or definite article is used when referring to a singular noun, e.g. "a", "an" or "the", this includes a plural of that noun unless something else is specifically stated.

In certain embodiments of the present invention, the individual is a human or a non-human animal, where such non-human animal may, in particular embodiments, be selected from the group consisting of: horse, sheep, cow, pig, chicken, mouse and rat. In a more specific embodiment, the individual is a pregnant female human or a human individual suspected of being at increased risk of developing or suffering (or suffering from) a medical condition, such as one or more of the medical conditions disclosed herein. Such a method of the present invention is not intended to be practiced on the human or animal body; for example it is intended to be practiced in an in-vitro manner.

In all aspects of the invention, the cell(s) of a given type may be a cell of a particular organ or tissues of the same individual. For example, the cell may be a tumour cell of the individual. Alternatively, such cell(s) may originate from a different individual or organism. For example, in the case of an individual being a pregnant female, the cell of a given type may be a cell of the foetus, including of the placenta of such foetus, and in other embodiments, the cell type may be an infectious agents such as a bacteria or a protozoa.

In certain embodiments of the present invention, said species of DNA and/or said differently methylated DNA is cell-free DNA, and in particular of such embodiments is circulating cell-free DNA. In one particular embodiment, said species of DNA and the differently methylated DNA that is admixed therewith are both circulating cell-free DNA. The term "cell-free DNA" (or "cfDNA") is art recognised, and includes the meaning of DNA that is found outside of a cell, such as in a biological fluid (eg blood, or a blood fraction) of an individual. "Circulating" is also an art-recognised term, and includes the meaning that an entity or substance (eg cfDNA) is present in, detected or identified in, or isolated from, a circulatory system of the individual, such as the blood system or the lymphatic system. In particular, when cfDNA is "circulating" it is not located in a cell, and hence may be present in the plasma or serum of blood, or it may be present in the lymph of lymphatic fluid.

The term "differentially methylated region" or "DMR" will be recognised by the person of ordinary skill in the art, and is also intended to refer to a region in chromosomal DNA that is differentially methylated (eg at a CpG motif) between said species of DNA and the other DNA with which it is admixed in the sample. For example in one embodiment, the DMRs used in the present invention are differentially methylated between foetal and maternal DNA, or are differentially methylated between tumour-derived and non-tumour-derived DNA from the same individual. In particular embodiments of the present invention, the DMRs are hypermethylated in foetal DNA and hypo methylated in maternal DNA, or are hypermethylated in tumour-derived DNA and hypomethylated in DNA that is derived from non-tumour tissue of the individual. That is, in such regions exhibit a greater degree (ie more) methylation in said species of DNA (eg the foetal or tumour cfDNA) as compared to the other DNA (eg maternal or non-tumour DNA), such as about 10%, 20%, 30%, 40%, 50%, 60%, 70%, 80%, 90% or 100% of, or more of, the sites available for methylation at a given DMR are methylated in said species of DNA as compared to the same sites in the other DNA.

A reagent is used in the present invention that differentially (eg selectively) modifies methylated as compared to non-methylated DNA. For example, treatment of DNA with a reagent comprising bisulphite (bisulfite) converts cytosine residues to uracil, but leaves 5-methylcytosine residues unaffected. Thus, bisulphite treatment introduces specific changes in the DNA sequence that depend on the methylation status of individual cytosine residues, yielding single-nucleotide resolution information about the methylation status of a segment of DNA. Various analyses can be performed on the altered sequence to retrieve this information, including the use of PCR primers and/or probes that can distinguish between such singe-nucleotide changes.

Such a reagent may alternatively (or in addition) comprise a restriction enzyme that is sensitive to the DNA methylation states. Cleavage of such a restriction enzyme's recognition sequence may be blocked, or impaired, when a particular base in the enzyme's recognition site is modified, eg methylated. In particular embodiments of all aspects of the invention, the reagent comprises a methylation-sensitive restriction enzyme, such as a methylation-sensitive restriction enzyme disclosed herein; including such embodiments that comprise two, three, four, five or more of such methylation-sensitive restriction enzymes.

Prior to step (a), the sample may be processed to isolate, enrich and/or purify, the DNA present therein. For example, a plasma sample may be processed using a cfDNA isolation process or kit to provide a (non-natural) subsequent solution that comprises an admixture of said species of DNA together with the differentially methylated DNA that does not originate from the cell-type. The step of treating in (a) may comprise the step of adding a separate solution that comprises said reagent (eg a methylation sensitive restriction enzyme) to the admixed DNA of the sample (eg, to a non-natural solution comprising such admixed DNA); and/or may comprise maintaining (or changing to) certain conditions. In particular, when said reagent comprises one or more methylation sensitive restriction enzyme, the step of treating in (a) may comprise incubating the DNA and the enzyme(s) together at about 37° C. for between about 5 min and 300 min, such as between about 30 min and 90 min or about 60 min, and optionally may comprise a step of incubating such mixture at a higher temperature (for example, between about 50° C. and 90° C., such as about 80° C.) so as to deactivate the enzyme(s). In certain embodiments, the composition formed for a treating step of (a) may be non-naturally occurring. For example, particular salts of components of the solution (or buffer); and/or the mixture of (eg human) cfDNA together with one or more bacterial-derived restriction enzymes (or a non-natural mutant thereof) may be a non-natural composition or mixture. Furthermore, any of the methods of the present invention may produce (and hence a composition of the present invention may comprise) an in-vitro-produced nucleic acid molecule, such as a DNA product of a PCR reaction (eg a "PCR product"). One or more of such in-vitro-produced nucleic acid molecules may be non-natural because they comprise a nucleotide primer and/or probe that includes at least one detectable label, such a nucleic acid molecule having been generated by polymerase extension (or partial nuclease digestion) of such a labelled primer and/or probe, and hence providing at least a fraction of such nucleic acid molecules that include a detectable label, such that even though the nucleic acid sequence of the nucleic acid molecules may comprise a naturally occurring sequence (or fragment thereof), such an in-vitro-produced nucleic acid molecule is non-natural by virtue of (at least) the non-natural detectable label that it includes.

In contrast, an "other region" ("OR") used in the present invention is not (significantly) differentially methylated between said species of DNA and other DNA with which it is admixed in the sample. For example, under the conditions and nature of the reagent used, there is no detectable difference between modification by such reagent at the other region of said species of DNA (eg foetal DNA) as compared to the other region of the admixed DNA (eg the maternal DNA). Such a non-difference may be achieved if the other region comprises no sites for methylation, if there is no difference in the degree of methylation if such sites are present, or by the use of a reagent that does not recognise any sites of methylation present in the other region. Accordingly, in alternative embodiments of the present invention, the at least one other region used in step (c) is one for which no (significant) difference in methylation between said species of DNA and the other DNA is (or can be) recognised or detected (or recognisable or detectable) with said reagent.

The other region, used in the present invention (that is not so differentially methylated) should be (particularly in the context of the first aspect of the present invention) or may be (particularly in the context of the second aspect of the present invention) non-overlapping with the DMR used in the present invention. For example, the other region, particularly when used in the context of the first aspect of the present invention, can be located further than about 10 bp, 20 bp, 50 bp, or more than 100 bp, 500 bp, 1 kb or 10 kb, away from the DMR, such as is located between about 20 bp and about 20 kb upstream or downstream of (including embodiments being located within the same gene as) said DMR. In particular, the genomic location of the other region used in the first aspect of the present invention is generally located in the same portion of the genome, such as between about 20 bp and about 20 kb upstream or downstream of (including embodiments being located within the same gene as) the genomic location of at least one of the DMRs used herein. The inventors find that, particularly in the context of the first aspect of the present invention, detection (and particularly quantification) of the species of DNA is enhanced (eg, in terms of sensitivity, accuracy and/or precision) if the other region is so located in the same portion of the genome as one of the DMRs. Without being bound by theory, it is believed that with such similarly-located DMR(s) and other region, particularly when used in the context of the first aspect of the present invention, the effect of variation in chromatin/nucleosome packing across the genome—and hence stability/degradation of different regions of genomic DNA—is mitigated, such that any difference in stability/degradation of a DMR (ie detecting the species of DNA) as compared to the other region (is detecting total DNA) is less, and hence a relative (and absolute) quantification may be made without it being (significantly) confounded by quantitative differences brought about by (significantly) differential chromatin/nucleosome packing across the genome between a DMR and an other region.

In one embodiment of the present invention, the detection of the various DNA regions, ie the DMR(s) and the other region(s), may occur in a simplified process. Correspondingly, one feature of the present invention is that the detection of the various DNA regions, ie the DMRs and the other region(s), occurs in a simplified process. For example, using a single aliquot of DNA from the sample, such DNA regions may be detected in a single vessel. This feature may simplify the method(s), and can provide for more efficient and accurate detection (especially in those embodiments when detection is quantitative). The term "vessel" will be art recognised, and includes embodiments of a vessel (such as a tube, well of a microtitre plate, nano-well, capillary reaction vessel etc) in which a process or procedure comprised in the method occurs, such as a reaction and/or detection process or a step of a method of the present invention. Other such vessels may include droplets in oil/water emulsions, nanoparticles or a hybridisation chamber; as appropriate to the detection technology used. The detectable labels used, in certain embodiments of the first aspect of the present invention may be the same for each DMR and/or may be the same for each other region, provided that, when detected essentially simultaneously, the label(s) used for the other region(s) is different (ie, can be separately detected) to the label(s) used for the DMR(s). Alternatively, the detectable labels used, in certain embodiments of the first aspect of the present invention may be different (eg, not the same) for each DMR (or, in respect of certain embodiments of the second aspect of the present invention may be the same for each set of two or more DMRs) and/or may be different (eg, not the same) for each other region. The detectable labels used in the method of the second aspect is the same for each DMR and, in certain embodiments, is the same for each other region, provided that the label(s) used for the other region(s) is different (ie, can be separately detected) to the label(s) used for the DMRs. Detectable labels that are "the same", can also include labels while structurally different, are functionally (essentially) similar as they cannot be significantly differentiated by the detection technology employed. For example, structurally different fluorescent dyes may be considered "the same" if their excitation and emission spectra are (substantially or essentially) similar, or overlap to such a degree that they are able to be excited and detected simultaneously with the same wavelength(s). Suitable labels (and detection modalities) are further described elsewhere herein. Preferably, the detection of the DMR(s) and other region(s) may be made effectively simultaneously. For example, within the same (reaction/detection) vessel, all such regions (and hence said species of DNA and total DNA) can be detected within less than about 5 s, 1 s, 0.5 s, 100 ms, 10 ms, 1 ms, 100 us, 10 us or 1 us of each other, and for example without transferring the vessel, or the reaction/mixture, to any subsequent vessel, assay or equipment, or for example, without adapting or recalibrating the detection process for (any/either of) the DMR(s) or the other region(s) separately. The use of (at least) two different detectable label(s)—one for said DMR(s) and one for the other region(s)—utilises components, process and/or steps that are non-natural. For example, a composition of two specific labels together with the specific DNA regions would (generally) not be found in nature. In particular, short probes used in quantitative probe-based PCR, while may comprise a DNA sequence that is a fragment of that found in a natural genome, when linked to a one or more labels (such as a fluorescent dye) form a specific labelled fragment that is non-natural.

Collectively, the features of the present invention provide for certain advantages over prior art methods. These can include sensitive detection of methylation (and hence the species of DNA to be detected) and/or accurate and/or improved precision quantification of the amount of said species of DNA by reference to the amount of total DNA detected: (1) in the first aspect of the present invention, using a co-located other region, and optionally within the same assay, from the same aliquot of admixed DNA and effectively simultaneously with the detection of the two or more DMRs; and/or (2) in the second aspect of the present invention, within the same assay, from the same aliquot of admixed DNA and effectively simultaneously with the detection of the two or more DMRs, and optionally using a co-located other region.

By way of graphical description, a schematic representation of the general arrangement of the DMR(s), the other region(s) and the detectable label(s), as used for the first aspect of the present invention, is presented in FIG. 1(a). (1) The presence of methylation in DNA at DMR1 is detected in the context of an other region ("OR1") is located within the same portion of the genome (eg, between about 20 bp and about 20 kb upstream or downstream of) DMR1. (2) Optionally, additional DMRs and/or ORs (such as DMR2 and/or OR2, and up to DMRn and ORn) may be detected, and pairs of such additional DMRs and ORs may each be co-located in the same portion of the genome (eg, between about 20 bp and about 20 kb upstream or downstream of) as each other. Optionally, (3) the presence of methylation in DNA is detected at multiple DMRs, using the same detectable label(s) and/or (4) the amount of total DNA detected using at least one OR (OR1, and optionally, OR2 or up to ORn) is detected using different detectable label(s) to those used to detect methylation at the DMR(s) (optionally, the detectable label(s) used is the same for all the ORs).

In particular embodiments of the first aspect of the present invention, said detection in step (b) comprises the use of two or more of said DMRs, and such two or more DMRs may be detected in such step using the same detectable label(s) for each of said DMRs, or using detectable labels that are not the same for each of said DMRs. The combination of a feature of the first aspect of the present invention (similarly-located DMR(s) and other region(s)) with one of more other feature of the present invention: eg the use of at least two DMRs, and/or the detection in step (b) and the detection in step (c) are made using the same aliquot of DNA of the sample, and in the same reaction/detection vessel, and effectively simultaneously for such DMRs and other region, and/or using: (x) the same detectable labels(s) for each of said DMRs; and/or (y) a different detectable label for said other region(s); is each a preferred embodiment of the present invention. The use of such a combination of features in the present invention provides opportunity for efficiency improvements and/or synergistic enchantment of outcome. For example, an improved sensitivity and/or accuracy and/or precision of detection (eg, detection of a quantitative amount) or said species of DNA can be obtained by the use of such a combination; the degree of improvement of which can be synergistic, as compared to the use of each feature alone; eg the enhancement obtained by use of the combined features being greater than the sum of each enhancement obtained by the use of each feature individually.

By way of graphical description, a schematic representation of the general arrangement of the DMRs, the other region(s) and the detectable label(s), as used for the second aspect of the present invention, is presented in FIG. 1(b). (1) The presence of methylation in DNA at two or more DMRs, DMR1 and DMR2 (and, optionally, up to DMRn), is in each case detected using the same detectable label(s). (2) Optionally, an other region ("OR") is located within the same portion of the genome (eg, between about 20 bp and about 20 kb upstream or downstream of) one of the DMRs). (3) The amount of total DNA detected using at least one OR (OR1, and optionally, OR2 or up to ORn) is detected using different detectable label(s) to those used to detect methylation at the DMRs (optionally, the detectable label(s) used is the same for all the ORs). (4) Optionally, methylation at more than two DMRs is so detected, and/or the amount of total DNA is detected at more than one OR.

In certain embodiments, prior to or as part of the detection that occurs as part of a step (b) and/or a step (c) of any method of present invention, each DNA region comprising said DMR(s) and/or said other region(s), respectively, is(are) amplified. Amplification of DNA may be conducted using any suitable replication process, and in particular of such embodiments, each of the DMR(s) and/or other region(s), is amplified by a polymerase chain reaction (PCR) using primers suitably designed for each DMR and/or other region. The person of ordinary skill will readily be able to design such PCR primers for use in the method of the invention, for example by use of primer design algorithms and programs such as Clone Manager Professional 9 (Sci-Ed Software), Vector NTI (Life Technologies), or web-based tools such as those found from www.ncbi.nlm.nih.gov/tools/primer-blast/or molbiol-tools.ca/PCR.htm. Those embodiments of the present invention that comprise PCR amplification can further comprises specific steps that are related to the practice of PCR, such as any of those described herein, or in particular the steps of: (A) providing a reaction mixture comprising a double-stranded target DNA, a pair of primers (for example, a pair of primers disclosed herein) designed to amplify a region of such DNA (such as a DMR or an other region as described herein) wherein the first primer is complementary to a sequence on the first strand of the target DNA and the second primer is complementary to a sequence on the second strand of the target DNA, Taq polymerase, and a plurality of free nucleotides comprising adenine, thymine, cytosine and guanine; (B) heating the reaction mixture to a first predetermined temperature for a first predetermined time to separate the strands of the target DNA from each other; (C) cooling the reaction mixture to a second predetermined temperature for a second predetermined time under conditions to allow the first and second primers to hybridise with their complementary sequences on the first and second strands of the target DNA, and to allow the Taq polymerase to extend the primers; and (D) repeating steps (B) and (C) at least 20 times.

In other embodiments, a detectable label used in step (b) and/or step (c) of a method of the invention is independently selected from the group consisting of: fluorescent, protein, small molecule or radioactive label. For example, fluorescent labels that are the same (including, by having similar or overlapping excitation and/or emission spectra) may be used for the DMR(s), and a fluorescent label that has an excitation and/or emission spectra (in particular, a different emission spectrum) may be used for detection of the other region(s). The person of ordinary skill will be able to select appropriate such fluorescent label(s) for use in the present invention from, for example, the group consisting of: FAM, TET, JOE, VIC, HEX, NED, PET, ROX, TAMRA, Quasar and Texas Red. In other embodiments, a detectable label may be a protein or small molecule tag that, for example, can be detected using a specific antibody and ELISA-type detection approaches. The use of the same protein or small molecule for each of the DMR(s), and a detectably different protein or small molecule for the other region(s), may also be utilised for the detectable label(s) used in the present invention. Different radioactive labels may be distinguished by their emission energy, penetration/excitation characteristics and particle-type (for example, by distinguishing between alpha and beta particles). Other detectable labels (such as nucleic-acid coded tag) may also be employed in the present invention.

In particular embodiments of the present invention, the detection in step (b) of a method of the example comprises real-time quantitative probe-based PCR, eg by using at least one labelled probe which is specific for one of the DMR(s). In those embodiments where PCR amplification of multiple DMRs is made in the same reaction, such PCR can be considered as "multiplex" (or "duplex" if only two DMRs are so amplified). Likewise, the detection in step (c) in the methods of the invention may, in addition or alternatively, comprise real-time quantitative probe-based PCR, such as by using at least one labelled probe specific for one of said other region(s). In particular embodiments of the second aspect of the present invention, the detection in step (b) of a method of the example comprises real-time quantitative probe-based PCR, eg by using at least two labelled probes, each of which is specific for one of said DMRs.

The term "probe-based" quantitative PCR is art recognised, and encompasses various embodiments described and marketed under different brand names (such as "TaqMan" PCR of Roche), and uses a (eg fluorescent) reporter probe that is specific for the detection of a given amplicon (eg a DMR or an other region). Probe-based quantitative PCR is distinct from quantitative PCR using double-stranded DNA-binding dyes (eg SYBR Green) as reporters, as such double-stranded DNA-binding dyes bind non-specially to any double-stranded amplicon and eg cannot be used to distinguish between detection of the DMR(s) (ie said species of DNA) from detection of the other region(s) (ie detection of total DNA). As the person of ordinary skill will appreciate, a specific amplicon of PCR may be detected using a single probe or by using multiple probes (such as two or three probes) for an amplicon. In particular, probe-based quantitative PCR can include amplification reactions into which have been incorporated processes of detecting a target nucleic acid using labelled oligonucleotides that use the 5' to 3' nuclease activity of a nucleic acid polymerase to cleave annealed labelled oligonucleotide (eg the probe) from hybridised duplexes and release labelled oligonucleotide fragments for detection. Such approaches and processes are known in the art and are described in more general terms by Gelfand et al (U55804375, EP0543942 and related family members) and/or Livak et al (U.S. Pat. No. 6,258,569, EP0792374 and related family members), and include where the probe comprises a detectable label in combination with a quencher molecule that quenches the detectability of the label when bound, such that 5' to 3' nuclease (and hence amplification) is required to occur before the detectable label is released into the reaction mixture (way from the quencher) and hence may be detected. Furthermore, "probe-based" quantitative PCR approaches may by alternatively or additionally enhanced by the use of probes that comprise an oligonucleotide-fluorophore-quencher-minor groove binder conjugates, such as described by Reed et al (U.S. Pat. No. 6,727,356, EP1235938 and related family members).

Such probe-based quantitative PCR may be conducted in an analogue-approach, using a machine such as a LightCycler in which the intensity of signal (eg over time) is measured and used to quantitatively determine detection. Systems and approaches for such detection are described by Woudenberg et al (U56929907, EP0706649 and related family members) and/or Higuchi (U55994056, EP0512334 and related family members). Alternatively, digital PCR (dPCR), ie, PCR conducted in multiple events so as to determine the number of amplification events as method to quantitate an amount of detected DNA. For example, dPCR that is conducted in nano-wells or droplets (ddPCR).

The person of ordinary skill will be able to design suitable primers and probes (and with suitable labels, eg dyes) for probe-based quantitative PCR detection of the DMRs and/or other regions(s); for example by using primer/probe design software as described elsewhere herein. As will be known, the PCR primers may overlap methylation site(s) specific for the methylation-specific modifying reagent used in the methods, in particular when the reagent comprises one or more methylation sensitive restriction enzyme, such as one (or a combination thereof) as disclosed herein. In particular such embodiments, one or other (or when considered together, both) of the PCR primers for a given DMR may overlap two or three such methylation sites (such as two or three restriction sites for methylation-sensitive restriction enzymes, each of which may comprise, or comprises, a methylation site). Alternatively or in addition, the primers for a DMR may be designed to flank one, two, three or more such methylation sites, such as up to 10, 15, 20, 25 or 50 such methylation sites, in particular flanking restriction sites for one, two, three or more such methylation sites, such as up to 10, 15, 20, 25 or 50 methylation-sensitive restriction enzymes, each of which may comprise, or comprises, a methylation site.

In a particular embodiment of the second aspect of the invention, the genomic location of the other region, when used in such aspect is generally located in the same portion of the genome, such as between about 20 bp and about 20 kb upstream or downstream of (including embodiments within the same gene as) the genomic location of at least one of the DMRs used herein. In certain embodiments of such aspect, the other region, when used in the second aspect of the present invention, does not overlap with the DMR. The inventors find that, in the second aspect of the present invention, detection (and particularly quantification) of the species of DNA is enhanced (eg, in terms of sensitivity, accuracy and/or precision) if the other region is so located in the same portion of the genome as one of the DMRs. Without being bound by theory, it is believed that with such similarly-located DMR(s) and other region when used in the second aspect of the present invention, the effect of variation in chromatin/nucleosome packing across the genome—and hence stability/degradation of different regions of genomic DNA—is mitigated, such that any difference in stability/degradation of a DMR (ie detecting the species of DNA) as compared to the other region (is detecting total DNA) is less, and hence a relative (and absolute) quantification may be made without it being (significantly) confounded by quantitative differences brought about by (significantly) differential chromatin/nucleosome packing across the genome between a DMR and an other region. The combination of this feature (similarly-located DMR(s) and other region) with another feature of the present invention (the use of at least two DMRs, and the detection in step (b) and the detection in step (c) are made using the same aliquot of DNA of the sample, and in the same reaction/detection vessel, and effectively simultaneously for such DMRs and other region, and using: (x) the same detectable labels(s) for each of said DMRs; and (y) a different detectable label for said other region(s)), is a preferred embodiment of the present invention. The use of such a combination of features in the present invention provides opportunity for efficiency improvements and/or synergistic enchantment of outcome. For example, an improved sensitivity and/or accuracy and/or precision of detection (eg, detection of a quantitative amount) or said species of DNA can be obtained by the use of such a combination; the degree of improvement of which can be synergistic, as compared to the use of each feature alone; eg the enhancement obtained by use of the combined features being greater than the sum of each enhancement obtained by the use of each feature individually.

Figure 1:
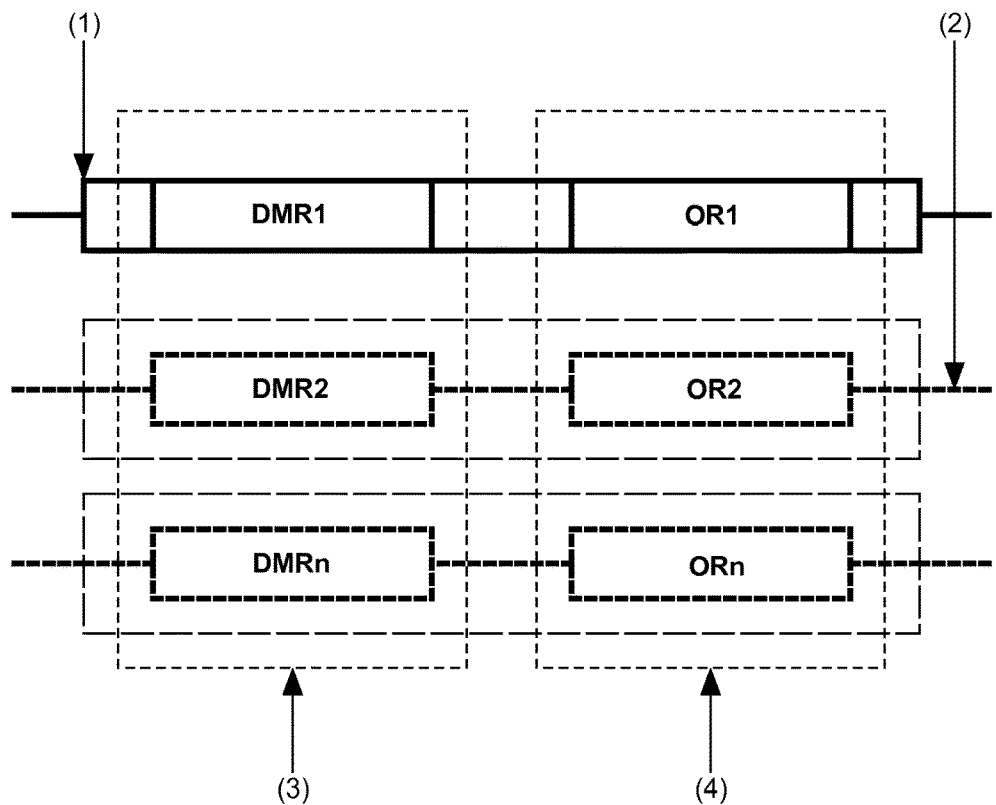
FIG. 1 depicts: (a) a schematic representation of the differentially methylated region(s) ("DMR") and other regions(s) ("OR") used in the method of the first aspect of the invention; and (b) a schematic representation of the differentially methylated regions ("DMR") and other regions(s) ("OR") used in the method of the second aspect of the invention.
Figure 1:
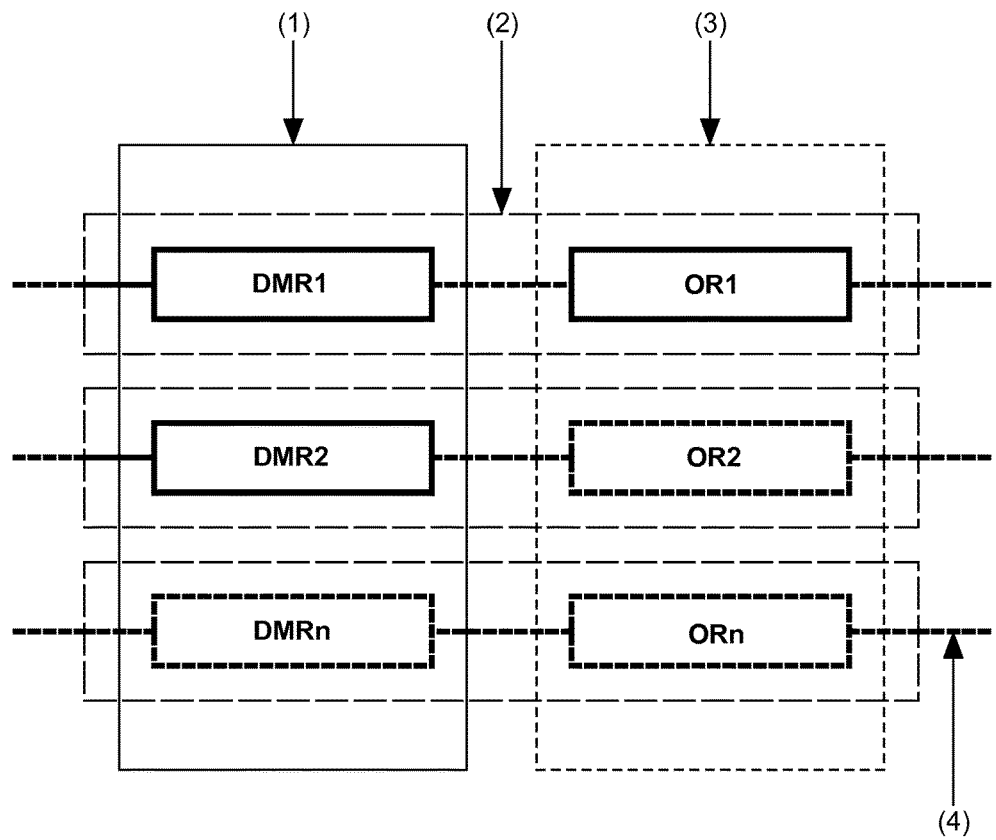

The present invention includes the use of one other region to provide for the detection of an amount of total DNA in the admixture. However, the present invention also encompasses embodiments that use more than one other region. For example, the invention includes such embodiments wherein said detection in step (c) comprises using at least two of said other regions, such as two, three or four of said other regions. In particular embodiments of all aspects of the present invention, the number of said other regions is the same as the number of DMRs used in step (b). For example, if two DMRs are used then two other regions are used in such an embodiment, and if three DMRs are used then three other regions are used (such as depicted in FIG. 1).

As described elsewhere herein, the first aspect of present invention includes where the other region is generally located in the same portion of the genome, such as between about 20 bp and about 20 kb upstream or downstream of (including embodiments within the same gene as) the genomic location of at least one of the DMRs used herein. Also as described elsewhere herein, certain embodiments of the second aspect of present invention include where the other region is generally located in the same portion of the genome, such as between about 20 bp and about 20 kb upstream or downstream of (including embodiments within the same gene as) the genomic location of at least one of the DMRs used herein. In certain embodiments of such second aspect, the other region does not overlap with the DMR. Accordingly, if multiple other regions are used in the present invention, then embodiments are included where two or more of such other regions are similarly located in the genome to the two or more DMRs. For example, one of said other regions may be located between about 20 bp and about 20 kb upstream or downstream of (including embodiments within the same gene as) a DMR used in step (b) and each other of the said other regions (eg, a second other region) is located between about 20 bp and about 20 kb upstream or downstream of (including embodiments within the same gene as) another of said (eg, non-overlapping) DMRs (eg, the second DMR). In certain embodiments an additional other region, may overlap with a DMR.

An other region used in the present invention, when generally located in the same portion of the genome as a DMR, may be located upstream or downstream of one of said DMRs within a distance selected from the group consisting of: between about 16 kb to 20 bp, 14 kb to 20 bp, 12 kb to 20 bp, 10 kb to 20 bp, 8 kb to 20 bp, 6 kb to 20 bp, 5 kb to 20 bp, 4 kb to 20 bp, 3 kb to 20 bp, 16 kb to 20 bp, 1 kb to 20 bp, 500 bp to 20 bp, 200 bp to 20 bp, 20 kb to 15 kb, 15 kb to 10 kb, 12 kb to 8 kb, 10 kb to 8 kb, 11 kb to 7 kb, 11 kb to 10 kb, 9 kb to 8 kb, 8 kb to 6 kb, 6 kb to 4 kb, 4 kb to 2 kb, 2 kb to 500 bp, 1 kb to 100 bp, 500 bp to 50 bp, 400 bp to 200 bp and 500 bp to 100 bp and 500 bp to 300 bp. In particular embodiments, each other region used in the present invention is so generally located to a different of the DMRs used.

If multiple other regions are used, then the present invention includes embodiments where the detection in step (c) is made using the same detectable label for each of said other regions and/or comprises multiplex real-time quantitative PCR using at least two labelled probes each of which is specific for one of said other regions.

In particular embodiments, all detection steps (ie, those required for all DMR(s) and all other region(s)) are conducted in an efficient and effective manner using multiplex quantitative probe-based (eg TaqMan) PCR, in one process step or reaction. For example, the detection in step (c) and said detection in step (b) are made using the same aliquot of DNA of said sample, and in the same reaction/detection vessel, and effectively simultaneously with each other, and by multiplex real-time quantitative PCR using at least one labeled probe specific for each of the said DMRs and other region(s). In particular of such embodiments, the reagent comprises one or more methylation sensitive restriction enzyme, such as one (or a combination thereof) as disclosed herein.

The present invention may also include further procedures, such as one or more control procedures. For example, the present invention can include one or more steps directed to the detection of a third class of DNA region that acts as a control for the modification step (eg, as a control for restriction enzyme digestion). Such embodiments may, for example, also be conducted using multiplex real-time quantitative probe-based PCR wherein such control region is amplified and detected by a third set of primer/probe(s) with a third detectable label used for such class of region.

In one embodiment of the present invention of particular relevance, said species of DNA originates from cells of a foetus and/or the placenta of a foetus and said sample is from a pregnant female. In such embodiments, the sample may be obtained in a non-invasive manner. For example, said species of DNA is circulating cell-free DNA that has been detected from the sample being blood or a blood fraction (such as plasma or serum) that has been obtained from the pregnant female by conventional means such as a blood collection tube. In such embodiments, the sample will comprise DNA (such as said other DNA) that has a maternal origin; that is it originates from cells (and hence the genome of) the pregnant female.

The present invention includes embodiments where the DMR(s) is(are) hypermethlyated in foetal DNA and hypo methylated in maternal DNA. In certain embodiments, such a DMR may be located in a promoter, enhancer region or an exon of a gene, such as a gene disclosed herein. Alternatively, a DMR may be located in an intron of such a gene, or in a non-coding region of the genome. In particular embodiments of all aspects of the present invention, such genome and/or gene is a human genome or gene. Specifically included in the present invention are embodiments wherein said DMR(s) comprises at least one, preferably at least two, methylation site(s) specific for said reagent, and at least one of said DMR(s) is located in a portion of the genome and/or gene (eg a human genome or gene) that is RASSF1A and/or TBX3, or selected from the group consisting of: RASSF1A, TBX3, HLCS, ZFY, CDC42EP1, MGC15523, SOX14 and SPN and DSCAM. Also, embodiments are included wherein said DMR(s) comprises at least one, preferably at least two, methylation site(s) specific for said reagent, and at least one of said DMR(s) is located in a region and/or gene selected from the group consisting of: AIRE, SIM2, ERG, VAPA-APCDDI, one disclosed in WO 2011/034631 as being hypermethylated in foetal DNA relative to maternal DNA (eg, SEQ ID NOs: 1-59, 90-163, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and/or 261 of WO 2011/034631) and one disclosed in WO 2011/092592 (eg, EP1, EP2, EP3, EP4, EP5, EP6, EP7, EP8, EP9, EP10, EP11 and/or EP12 of WO 2011/092592 (SEQ ID NOs: 33-44 of WO 2011/092592), as further investigated in Lim et al 2014, BMC Medical Genomics 7:1). TABLE A shows the conversion of the sequence identifiers used in the WO 2011/034631 and WO 2011/092592 to the sequence identifiers used in the present invention.

TABLE A

Conversion table for sequence indentifiers

| SEQ ID NO.: Present invention | SEQ ID NO.: WO 2011/034631 | SEQ ID NO.: WO 2011/092592 |
|---|---|---|
| SEQ ID NO.: 15 | 1 | — |
| SEQ ID NO.: 16 | 2 | — |
| SEQ ID NO.: 17 | 3 | — |
| SEQ ID NO.: 18 | 4 | — |
| SEQ ID NO.: 19 | 5 | — |
| SEQ ID NO.: 20 | 6 | — |
| SEQ ID NO.: 21 | 7 | — |
| SEQ ID NO.: 22 | 8 | — |
| SEQ ID NO.: 23 | 9 | — |
| SEQ ID NO.: 24 | 10 | — |
| SEQ ID NO.: 25 | 11 | — |
| SEQ ID NO.: 26 | 12 | — |
| SEQ ID NO.: 27 | 13 | — |
| SEQ ID NO.: 28 | 14 | — |
| SEQ ID NO.: 29 | 15 | — |
| SEQ ID NO.: 30 | 16 | — |
| SEQ ID NO.: 31 | 17 | — |
| SEQ ID NO.: 32 | 18 | — |
| SEQ ID NO.: 33 | 19 | — |
| SEQ ID NO.: 34 | 20 | — |
| SEQ ID NO.: 35 | 21 | — |
| SEQ ID NO.: 36 | 22 | — |
| SEQ ID NO.: 37 | 23 | — |
| SEQ ID NO.: 38 | 24 | — |
| SEQ ID NO.: 39 | 25 | — |
| SEQ ID NO.: 40 | 26 | — |
| SEQ ID NO.: 41 | 27 | — |
| SEQ ID NO.: 42 | 28 | — |
| SEQ ID NO.: 43 | 29 | — |
| SEQ ID NO.: 44 | 30 | — |
| SEQ ID NO.: 45 | 31 | — |
| SEQ ID NO.: 46 | 32 | — |
| SEQ ID NO.: 47 | 33 | — |
| SEQ ID NO.: 48 | 34 | — |
| SEQ ID NO.: 49 | 35 | — |
| SEQ ID NO.: 50 | 36 | — |
| SEQ ID NO.: 51 | 37 | — |
| SEQ ID NO.: 52 | 38 | — |
| SEQ ID NO.: 53 | 39 | — |
| SEQ ID NO.: 54 | 40 | — |
| SEQ ID NO.: 55 | 41 | — |
| SEQ ID NO.: 56 | 42 | — |
| SEQ ID NO.: 57 | 43 | — |
| SEQ ID NO.: 58 | 44 | — |
| SEQ ID NO.: 59 | 45 | — |
| SEQ ID NO.: 60 | 46 | — |
| SEQ ID NO.: 61 | 47 | — |
| SEQ ID NO.: 62 | 48 | — |
| SEQ ID NO.: 63 | 49 | — |
| SEQ ID NO.: 64 | 50 | — |
| SEQ ID NO.: 65 | 51 | — |
| SEQ ID NO.: 66 | 52 | — |
| SEQ ID NO.: 67 | 53 | — |
| SEQ ID NO.: 68 | 54 | — |
| SEQ ID NO.: 69 | 55 | — |
| SEQ ID NO.: 70 | 56 | — |
| SEQ ID NO.: 71 | 57 | — |
| SEQ ID NO.: 72 | 58 | — |
| SEQ ID NO.: 73 | 59 | — |
| SEQ ID NO.: 74 | 90 | — |
| SEQ ID NO.: 75 | 91 | — |
| SEQ ID NO.: 76 | 92 | — |
| SEQ ID NO.: 77 | 93 | — |
| SEQ ID NO.: 78 | 94 | — |
| SEQ ID NO.: 79 | 95 | — |
| SEQ ID NO.: 80 | 96 | — |
| SEQ ID NO.: 81 | 97 | — |
| SEQ ID NO.: 82 | 98 | — |
| SEQ ID NO.: 83 | 99 | — |
| SEQ ID NO.: 84 | 100 | — |
| SEQ ID NO.: 85 | 101 | — |
| SEQ ID NO.: 86 | 102 | — |
| SEQ ID NO.: 87 | 103 | — |
| SEQ ID NO.: 88 | 104 | — |
| SEQ ID NO.: 89 | 105 | — |
| SEQ ID NO.: 90 | 106 | — |
| SEQ ID NO.: 91 | 107 | — |
| SEQ ID NO.: 92 | 108 | — |
| SEQ ID NO.: 93 | 109 | — |
| SEQ ID NO.: 94 | 110 | — |
| SEQ ID NO.: 95 | 111 | — |
| SEQ ID NO.: 96 | 112 | — |
| SEQ ID NO.: 97 | 113 | — |
| SEQ ID NO.: 98 | 114 | — |
| SEQ ID NO.: 99 | 115 | — |
| SEQ ID NO.: 100 | 116 | — |
| SEQ ID NO.: 101 | 117 | — |
| SEQ ID NO.: 102 | 118 | — |
| SEQ ID NO.: 103 | 119 | — |
| SEQ ID NO.: 104 | 120 | — |
| SEQ ID NO.: 105 | 121 | — |
| SEQ ID NO.: 106 | 122 | — |
| SEQ ID NO.: 107 | 123 | — |
| SEQ ID NO.: 108 | 124 | — |
| SEQ ID NO.: 109 | 125 | — |
| SEQ ID NO.: 110 | 126 | — |
| SEQ ID NO.: 111 | 127 | — |
| SEQ ID NO.: 112 | 128 | — |
| SEQ ID NO.: 113 | 129 | — |
| SEQ ID NO.: 114 | 130 | — |
| SEQ ID NO.: 115 | 131 | — |
| SEQ ID NO.: 116 | 132 | — |
| SEQ ID NO.: 117 | 133 | — |
| SEQ ID NO.: 118 | 134 | — |
| SEQ ID NO.: 119 | 135 | — |
| SEQ ID NO.: 120 | 136 | — |
| SEQ ID NO.: 121 | 137 | — |
| SEQ ID NO.: 122 | 138 | — |
| SEQ ID NO.: 123 | 139 | — |
| SEQ ID NO.: 124 | 140 | — |
| SEQ ID NO.: 125 | 141 | — |
| SEQ ID NO.: 126 | 142 | — |
| SEQ ID NO.: 127 | 143 | — |
| SEQ ID NO.: 128 | 144 | — |
| SEQ ID NO.: 129 | 145 | — |
| SEQ ID NO.: 130 | 146 | — |
| SEQ ID NO.: 131 | 147 | — |
| SEQ ID NO.: 132 | 148 | — |
| SEQ ID NO.: 133 | 149 | — |
| SEQ ID NO.: 134 | 150 | — |
| SEQ ID NO.: 135 | 151 | — |
| SEQ ID NO.: 136 | 152 | — |
| SEQ ID NO.: 137 | 153 | — |
| SEQ ID NO.: 138 | 154 | — |
| SEQ ID NO.: 139 | 155 | — |
| SEQ ID NO.: 140 | 156 | — |

TABLE A-continued

Conversion table for sequence indentifiers

| SEQ ID NO.: Present invention | SEQ ID NO.: WO 2011/034631 | SEQ ID NO.: WO 2011/092592 |
|---|---|---|
| SEQ ID NO.: 141 | 157 | — |
| SEQ ID NO.: 142 | 158 | — |
| SEQ ID NO.: 143 | 159 | — |
| SEQ ID NO.: 144 | 160 | — |
| SEQ ID NO.: 145 | 161 | — |
| SEQ ID NO.: 146 | 162 | — |
| SEQ ID NO.: 147 | 163 | — |
| SEQ ID NO.: 148 | 176 | — |
| SEQ ID NO.: 149 | 179 | — |
| SEQ ID NO.: 150 | 180 | — |
| SEQ ID NO.: 151 | 184 | — |
| SEQ ID NO.: 152 | 188 | — |
| SEQ ID NO.: 153 | 189 | — |
| SEQ ID NO.: 154 | 190 | — |
| SEQ ID NO.: 155 | 191 | — |
| SEQ ID NO.: 156 | 193 | — |
| SEQ ID NO.: 157 | 195 | — |
| SEQ ID NO.: 158 | 198 | — |
| SEQ ID NO.: 159 | 199 | — |
| SEQ ID NO.: 160 | 200 | — |
| SEQ ID NO.: 161 | 201 | — |
| SEQ ID NO.: 162 | 202 | — |
| SEQ ID NO.: 163 | 203 | — |
| SEQ ID NO.: 164 | 205 | — |
| SEQ ID NO.: 165 | 206 | — |
| SEQ ID NO.: 166 | 207 | — |
| SEQ ID NO.: 167 | 208 | — |
| SEQ ID NO.: 168 | 209 | — |
| SEQ ID NO.: 169 | 210 | — |
| SEQ ID NO.: 170 | 211 | — |
| SEQ ID NO.: 171 | 212 | — |
| SEQ ID NO.: 172 | 213 | — |
| SEQ ID NO.: 173 | 214 | — |
| SEQ ID NO.: 174 | 221 | — |
| SEQ ID NO.: 175 | 223 | — |
| SEQ ID NO.: 176 | 225 | — |
| SEQ ID NO.: 177 | 226 | — |
| SEQ ID NO.: 178 | 231 | — |
| SEQ ID NO.: 179 | 232 | — |
| SEQ ID NO.: 180 | 233 | — |
| SEQ ID NO.: 181 | 235 | — |
| SEQ ID NO.: 182 | 239 | — |
| SEQ ID NO.: 183 | 241 | — |
| SEQ ID NO.: 184 | 257 | — |
| SEQ ID NO.: 185 | 258 | — |
| SEQ ID NO.: 186 | 259 | — |
| SEQ ID NO.: 187 | 261 | — |
| SEQ ID NO.: 188 | — | 33 |
| SEQ ID NO.: 189 | — | 34 |
| SEQ ID NO.: 190 | — | 35 |
| SEQ ID NO.: 191 | — | 36 |
| SEQ ID NO.: 192 | — | 37 |
| SEQ ID NO.: 193 | — | 38 |
| SEQ ID NO.: 194 | — | 39 |
| SEQ ID NO.: 195 | — | 40 |
| SEQ ID NO.: 196 | — | 41 |
| SEQ ID NO.: 197 | — | 42 |
| SEQ ID NO.: 198 | — | 43 |
| SEQ ID NO.: 199 | — | 44 |

In other embodiments of the present invention, at least one of said DMR(s) is located on a human chromosome selected from the list consisting of: chromosome 21, chromosome 18, chromosome 13, X-chromosome and Y-chromosome, preferably at least one of said DMR(s) is located on chromosome 21, chromosome 18 or chromosome 13, more preferably at least one of said DMR(s) is located on chromosome 21. In other or further embodiments of the present invention, at least one of said DMR(s) comprises at least one, preferably at least two, methylation site(s) specific for said reagent, and said DMR is located in a region and/or gene selected from the list consisting of: maspin (and preferably a portion of the maspin (aka "SERPINB5") gene that is described in EP1751307 as being differentially methylated between a foetus and its mother), CGI137, PDE9A, PPP1R2P2, Similarity to Fem1A (*C. elegans*), CGI009, CBR1, DSCAM, C21orf29 and CGI13 (or such as a gene and/or region disclosed in Table 1 of WO 2007/132167 or in Chim et al 2008 that are unmethylated in maternal blood cells and methylated in placenta).

Human chromosome 21, chromosome 18, chromosome 13 and X-chromosome are those that are generally considered to be associated with chromosomal aneuploidy (particularly of a foetus), and using at least one DMR that is located in genes or regions of such chromosomes are particularly preferred for those methods of the present invention for the detection, identification or quantification of a species of DNA that is associated with a chromosomal aneuploidy and/or for the diagnosis of chromosomal aneuploidy (particularly of a foetus) such as a chromosomal trisomy including trisomy of chromosome 21 (also known as Down's Syndrome). Accordingly, in certain embodiments of the present invention, at least one of said DMR(s) is located in a region and/or gene selected from the list consisting of: SEQ ID NOs 1-39, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and/or 261 of WO 2011/034631, preferably selected from the list consisting of: SEQ ID No NOs 33-39, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and/or 261 of WO 2011/034631, more preferably selected from the list consisting of: SEQ ID No NOs 184, 191, 201, 202, 208, 209, 210, 211, 212, 214, 235, 241 and 258 of WO 2011/034631.

In other or further embodiments of the present invention, at least one of said DMR(s) comprises at least one, preferably at least two, methylation site(s) specific for said reagent, and at least one of said DMR(s) is located in a region and/or gene disclosed in WO 2011/092592, including on selected from the list(s) consisting of: EP1, EP2, EP3, EP4, EP5, EP6, EP7, EP8, EP9, EP10, EP11 and EP12 of WO 2011/092592 (SEQ ID NOs: 33-44 of WO 2011/092592). In yet other or further embodiments of the present invention, at least one of said DMR(s) comprises at least one, preferably at least two, methylation site(s) specific for said reagent, and at least one of said DMR(s) is located in a region and/or gene selected from the list consisting of: AIRE, SIM2, ERG and VAPA-APCDDI, or is HLCS.

In certain embodiments of the invention, at least one of the said DMRs is located on a human chromosome that is not (or rarely) associated with a chromosomal aneuploidy. In such embodiments, such chromosome can be considered as a (diploid) "reference chromosome", from which a species of DNA may be detected, identified or quantified that reflects an estimate of total diploid DNA of eg the foetus relative to maternal DNA. A parameter (such as a relative or absolute amount) in respect of such detected, identified or quantified species of DNA (from such a "reference" chromosome) can then be compared to a corresponding parameter in respect of a detected, identified or quantified species of DNA from a chromosome, or part thereof, associated with a chromosomal aneuploidy (such as trisomy); where any significant difference in such compared parameters (such as an excess of one chromosomal amount over another chromosomal amount) being indicative that a chromosomal aneuploidy may exist. Accordingly, in certain embodiments of the invention, at least one of the said DMRs is located on a human chromosome selected from the list consisting of: chromosome 1 to 12, chromosome 14 to 17, chromosome 19, chromosome 20 chromosome 22 and chromosome 23, preferably said DMRs is located on a human chromosome 2, chromosome 3 or chromosome 12; In other or further embodiments of the present invention, at least one of said DMR(s) comprises at least one, preferably at least two, methylation site(s) specific for said reagent, and said DMR is located in a regions and/or gene selected from the list consisting of: CD48, FAIM3, ARHGAP25, SELPLG, APC, CASP8, RARB, SCGB3A1, DAB2IP, PTPN6, THY1, TMEFF2 and PYCARD. In alternative or additional other or further embodiments of the present invention, at least one of said DMR(s) is located in a region and/or gene selected from the list consisting of: RASSF1A, TBX3, ZFY, CDC42EP1, MGC15523, SOX14 and SPN; and/or said DMR(s) is located in a region and/or gene selected from the list consisting of: SEQ ID NOs: 40-59 and 90-163 of WO 2011/034631.

If two DMRs are used, then in particular embodiments of all aspects of the present invention, they are not located in the same portion of the genomic and/or gene. For example, such DMRs may be located on separate chromosomes, or separated by more than about 20 kb, or more than about 15 kb, 10 kb, 8 kb, 6 kb, 4 kb, 2 kb, 1 kb, 500 bp or 200 bp. Alternatively, it is envisioned, that when two (or more) DMRs are used in the present invention, they may, in certain embodiments, be located in the same region or gene (such as one described herein) and, further, may overlap with each other.

In particular embodiments of the present invention, a plurality of species of DNA are detected in said sample. For example, two (or more) species of DNA can be detected (identified or quantified) in said sample using a method of the invention. Each species of DNA may be on (or originate from) separate chromosomes; including a first species of DNA on (or originating from) a chromosome relevant to a chromosomal aneuploidy (for example, human chromosome 21, 18, 13 or X), and a second species of DNA on (or originating from) a reference chromosome (for example, human chromosome 1 to 12, 14 to 17, 19, 20, 22 or 23. The detection, identification or quantification of a first species of DNA on (or originating from) a chromosome relevant to a chromosomal aneuploidy, and of a second species of on (or originating from) a reference chromosome, can enable respective parameters (such as a relative or absolute amount) from each such detection, identification or quantification to be compared (for example, via relative amount or ratio) and hence useful for the detection, identification or diagnosis of a chromosomal aneuploidy, particularly in a foetus.

In particular embodiments of the present invention, when two of said DMRs are used (or more than two DMRs are being used) each is located in a portion of the genome and/or gene (preferably that is human) that is RASSF1A and/or TBX3, or is selected from the group consisting of: RASSF1A, TBX3, HLCS, ZFY, CDC42EP1, MGC15523, SOX14 and SPN and DSCAM; and/or at least one of said DMRs is located between about positions 4,700 bp and 5,600 bp of RASSF1A (NCBI Reference Sequence: NG_023270.1: *Homo sapiens* Ras association (RalGDS/AF-6) domain family member 1 (RASSF1), RefSeqGene on chromosome 3; SEQ ID NO.: 13) or about positions 1,660 bp and 2,400 bp of TBX3 (NCBI Reference Sequence: NG_008315.1: *Homo sapiens* T-box 3 (TBX3), RefSeqGene on chromosome 12; SEQ ID NO.: 14) or is located between about positions 40,841,584 and 40,842,020 of DSCAM; (Down Syndrome Cell Adhesion Molecule; NCBI Reference Sequence *Homo sapiens* chromosome 21, GRCh38.p2 Primary Assembly: NC_000021.9 GI:568815577, region 40,010,999 to 40,847,113; SEQ ID No.: 200). In a more particular embodiment, two (or more) DMRs are used, and a first DMR comprises one located between about positions 4,700 bp and 5,600 bp of RASSF1A and a second DMR comprises one located between about positions 1,660 bp and 2,400 bp of TBX3.

In particular embodiments, a DMR is located in RASSF1A between about positions 4,900 bp and 5,500 bp, 5,000 bp and 5,400 bp, or 5,100 bp and 5,300 bp of RASSF1A; and/or is located in TBX3 between about positions 1,800 bp and 2,260 bp, 1,920 bp and 2,160 bp or 1,920 bp and 2,080 bp of TBX3 (such as SEQ ID No.: 203); and/or is located in DSCAM between about positions 40,841,600 bp and 40,841,900 bp, 40,841,625 bp and 40,841,840 bp or 40,841,650 bp and 40,841,790 bp of DSCAM (with reference to *Homo sapiens* chromosome 21, GRCh38.p2 Primary Assembly: NC_000021.9 GI:568815577, region), such as SEQ ID No.: 201.

Figure 2:
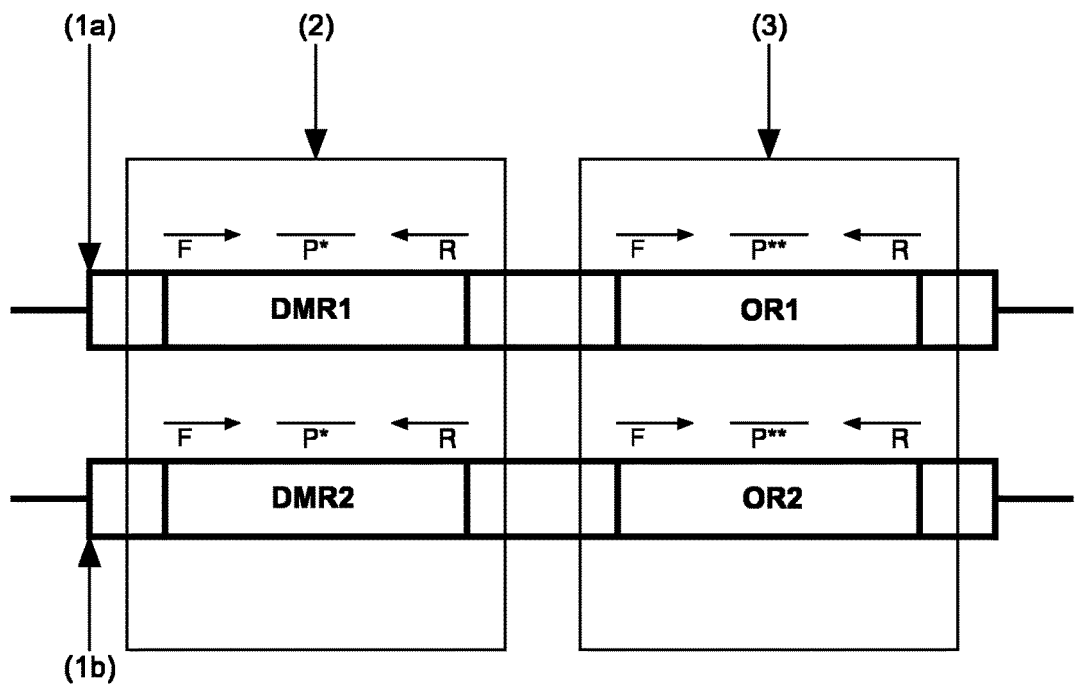
FIG. 2 depicts a schematic representation of the differentially methylated regions ("DMR") and other regions ("OR") used in Example 1.

The general arrangement of the DMRs and other regions ("OR") used in one embodiment of the present invention, is graphically represented by FIG. 2: (1a) DMR1 is found in exon 2 of RASSF1A and OR1 is located within exon 4 of RASSF1A, with DMR1 located between positions 50,340,672 bp and 50,340,784 bp and OR1 located between positions 50,331,604 bp and 50,331,702 bp of the RASS1A genomic sequence (NCBI Reference Sequence: NC_000003.12 *Homo sapiens* chromosome 3, GRCh38 Primary Assembly), separating DMR1 and OR1 by a distance of 8,969 bp. (1b) DMR2 is found in the promoter region of TBX3, with DMR2 located between positions 114,687,095 bp and 114,687,189 bp and OR2 is located between positions 114,676,384 bp and 114,676,454 bp of the TBX3 genomic sequence (NCBI Reference Sequence: NC_000012.12 *Homo sapiens* chromosome 12, GRCh38 Primary Assembly), separating DMR2 and OR2 by a distance of 10,640 bp. (2) Methylation in DNA at the two DMRs is detected using probe-based quantitative PCR using the respective forward (F) and reverse (R) PCR primers and region-specific probes, each probe labelled with the same labels (P*). (3) Total DNA is detected at two ORs using probe-based quantitative PCR using the respective forward (F) and reverse (R) PCR primers and region-specific probes, each probe labelled with the same labels for the ORs that is different to the labels used for the two DMRs (P**). Details of primer and probe sequences and probe labels are set out in TABLE 1.

Figure 6:
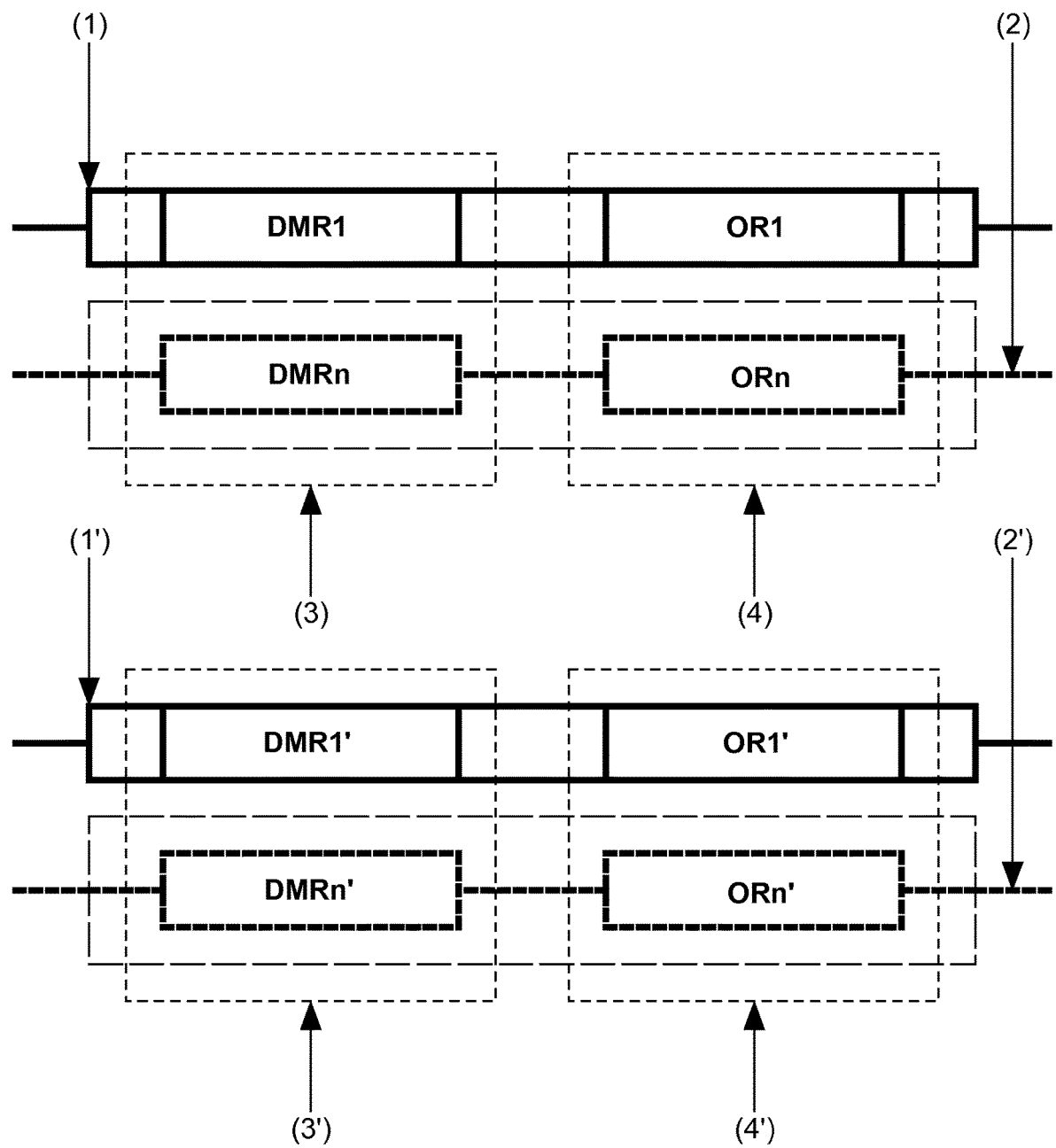
FIG. 6 depicts a schematic representation of the differentially methylated regions ("DMR") and other regions ("OR") used in EXAMPLE 5, and based on a method of the first aspect of the present invention.

The general arrangement of the DMRs and other regions ("OR") used in another embodiment of the present invention, is graphically represented by FIG. 6: (1) DMR1 is found in eg DSCAM and OR1 is located in eg DSCAM, with DMR1 located between positions 40,841,691 bp and 40,841,781 bp and OR1 located between positions 40,841,286 bp and 40,841,772 bp of the DSCAM genomic sequence (Down Syndrome Cell Adhesion Molecule; NCBI Reference Sequence *Homo sapiens* chromosome 21, GRCh38.p2 Primary Assembly: NC_000021.9 GI:568815577, region 40010999 to 40847113; SEQ ID No.: 200), separating DMR1 and OR1 by a distance between about 300 bp and 500 bp. (1') DMR1' is found in TBX3 and OR1' is located in TBX3, with DMR1' located between positions 114,687,093 bp and 114,687,191 bp and OR1' located between positions 114,676,384 bp and 114,676,454 of the TBX3 genomic sequence (NCBI Reference Sequence: NC_000012.12 *Homo sapiens* chromosome 12, GRCh38

Primary Assembly), separating DMR1' and OR1' by a distance between about 10,600 bp and 10,810 bp.

Certain embodiments of the present invention, in the context of the methods, compositions, kits and/or computer program product thereof, comprise or comprise the use of one or more of the forgoing DMRs, ORs, sequences of the primers and/or probes, in particular any of those set forth in TABLE 1 or TABLE 8. In certain of such embodiments, a given probe comprises a sequence set forth in TABLE 1 or TABLE 8 and any one of the label and quencher pairs (optionally, with a minor binding groove moiety) as set forth in TABLE 1 or TABLE 8. In particular, the probe may comprise the combination of the sequence with the label and quencher pair (optionally, with the minor binding groove moiety) as set forth in TABLE 1 or TABLE 8 for such probe. Other embodiments of the present invention, particularly in the context of the methods, compositions, kits and/or computer program product thereof, comprise or comprise the use of the specific combination of two or more (for example, of all) the foregoing DMRs, ORs, sequences of the primers and/or probes, in particular the combination of the primers/probes as set forth in TABLE 1 or the combination of the primers/probes as set forth in TABLE 8.

The term "methylation site(s)" will be art-recognised, and has a meaning that encompasses, for example, a CpG motif within a short nucleotide sequence (eg one that is 4, 6, 8, 10 or 12 bp in length) that is, preferably, recognised by a methylation-sensitive restriction enzyme, such as one disclosed elsewhere herein.

Analogously, and particularly in the context of the first aspect of the present invention, the other region, when located in particular portions and/or genes of the genome, may be located in a promoter, enhancer region or an exon of a gene, or alternatively, located in an intron of such a gene, or in a non-coding region of the genome. In particular embodiments of all aspects of the present invention, such genome and/or gene is a human genome or gene. In particular embodiments, when an other region used in the present invention is located in the same portion of the genome and/or gene that features one or more DMRs (preferably, non-overlapping with a DMR used in the invention), then it is located in a portion of the genome and/or gene such as a gene (eg human, and/or in particular when said species of DNA is foetal cfDNA) that is RASSF1A and/or TBX3, or is selected from the group consisting of: RASSF1A, TBX3, HLCS, ZFY, CDC42EP1, MGC15523, SOX14 and SPN and DSCAM. When not co-located with a DMR (for example, when a second or multiple other region is used), then such other region may, in certain embodiments, be located in a (eg human) housekeeping gene (such as GAPDH, beta-actin, ALB, APOE or RNASEP). Analogously, and particularly in the context of the second aspect of the present invention, the other region may be located in particular portions and/or genes of the genome, and may be located in a promoter, enhancer region or an exon of a gene, or alternatively, located in an intron of such a gene, or in a non-coding region of the genome. In particular embodiments of all aspects of the present invention, such genome and/or gene is a human genome or gene. In particular embodiments, an other region used in the present invention is located in a (eg human) housekeeping gene (such as GAPDH, beta-actin, ALB, APOE or RNASEP). Alternatively (and in particular when said species of DNA is foetal cfDNA), said other region may be located in the same portion of the genome and/or gene that feature one or more DMRs (such as those RASSF1A, TBX3, HLCS, ZFY, CDC42EP1, MGC15523, SOX14 or SPN or DSCAM), and preferably does not overlap with a DMR used in the invention.

In particular embodiments of all aspects of the invention, said other region comprises a portion of the genome without a methylation site specific for said reagent, and said other region is located in the (eg human) genes RASSF1A or TBX3 (eg SEQ ID NOs: 13 and 14 respectively) or DSCAM (SEQ ID No.: 200), and includes more particular embodiments wherein two or more of said other regions are used in detection step (c) and the first other region is located between about positions 14,220 bp and 13,350 bp of such RASSF1A and the second other region is located between about positions 12,400 bp and 13,000 bp of such TBX3. In particular embodiments, an other region is located in RASSF1A between about positions 14,230 bp and 14,340 bp, 14,230 bp and 14,330 bp, 14,230 bp and 14,320 bp, or 14,230 bp and 14,310 bp of such RASSF1A; and/or is located in TBX3 between about positions 12,400 bp and 12,940 bp, 12,700 bp and 12,850 bp or 12,710 bp and 12,790 bp of such TBX3 (such as SEQ ID No.: 204); and/or is located in DSCAM between about positions 40,841,150 bp and 40,841,525 bp, 40,841,200 bp and 40,841,475 bp or 40,841,250 bp and 40,841,425 bp of DSCAM (with reference to *Homo sapiens* chromosome 21, GRCh38.p2 Primary Assembly: NC_000021.9 GI:568815577, region), such as SEQ ID No.: 202. Alternatively, an other region may be located in an exon such as between about positions 13,790 bp and 13,880 bp, or 14,490 bp and 14,600 bp of such RASSF1A, or between about positions 8,040 bp and 8,180 bp or 6,230 bp and 6,350 bp of such TBX3; or an other region may be located in an intron such as between about positions 10,500 bp and 11.90 bp of such RASSF1A, or between about positions 10,000 bp and 11,000 bp of such TBX3

There is now strong evidence that the level of foetal cfDNA (and/or total cfDNA) present in the circulatory system (eg in plasma) of a pregnant female is a marker of one or more forms of preeclampsia, such as early-onset preeclampsia, mild and/or severe preeclampsia (see Hahn et al 2011, Placenta 32(Supl):S17). The present invention shows particular utility in the efficient, effective, sensitive and/or low-variability detection/quantification of foetal cfDNA present in plasma of pregnant females, and the present invention has particular utility therein. Accordingly, in particular embodiments of the present invention, the individual is a pregnant female and is susceptible to suffering or developing a pregnancy-associated medical condition; particularly where said pregnancy-associated medical condition is preeclampsia. As used herein, an individual "susceptible to" a medical condition may alternatively be described as "is suspected to" or to "be considered at risk of being susceptible to" suffering or developing a medical condition; and in certain embodiments, the present invention is used to screen and/or diagnose the individual for susceptibility to, risk of suffering or developing, or suffering from or developing, a medical condition.

In alternative embodiments, the individual is a pregnant female and is susceptible to (or considered at risk of being susceptible to) suffering or developing a pregnancy-associated medical condition selected from the group consisting of: preterm labour, intrauterine growth retardation and vanishing twin. In particular, the inventors were surprised that the sensitivity of the present invention was such that discrepancies between cfDNA levels determined by the method of the invention and that determined by counts of Y-chromosome sequences as determined by massively parallel sequencing approaches, was useful in identifying one or more cases of a vanishing twin in (mixed-sex) twin pregnancies that previously were believed to be singleton pregnancies, and/or to follow the relative development and health of one or other of such (mixed-sex) twin pregnancies. The present invention may also be utilised in gender determination of twin pregnancies, by consideration of the relative values for foetal cfDNA compared to counts of Y-chromosome sequences determined from cfDNA (eg by using parallel sequencing approaches). In these regards, it should be noted that approaches that use massively-parallel sequencing of random cfDNA in maternal blood typically always count a very low frequency of "Y-chomomosone" sequences (such as between about 0.003% and 0.004% of all sequences, or between about 0.0015% and 0.01% or 0.002% and 0.005% of all sequences) in all female pregnancies due to homology of certain Y-chromosome short sequences to other chromosomes. A cut off of "Y-chromosome" sequence counts of about 0.005%, or between about 0.003%, 0.004%, 0.006% or 0.007%, may therefore be employed for female samples.

As described elsewhere herein, there is also increasing evidence that the presence and amount of methylated DNA at certain DMRs is indicative or prognostic of certain medical conditions that are not associated with pregnancy. Accordingly, in another particular embodiment of the present invention, said species of DNA originates from a cell type associated with such a medical condition, particularly in those embodiments where said species of DNA is circulating cell-free DNA and said sample is a blood fraction such as plasma or serum. For example, the medical condition may be a cell proliferative disorder, such as a tumour or cancer. In particular embodiments, the medical condition is a tumour or a cancer of an organ selected from the list consisting of: liver, lung, breast, colon, oesophagus, prostate, ovary, cervix, uterus, testis, brain, bone marrow and blood; and/or said species of DNA may originate from cells of a tumour; particularly where such tumour is a carcinoma or cancer of an organ selected from the group consisting of: liver, lung, breast, colon, oesophagus, prostate, ovary, cervix, uterus, testis, brain, bone marrow and blood.

When used in the context of a medical condition being a tumour or cancer, the present invention includes embodiment wherein said DMR(s) comprises at least one, preferably at least two, methylation site(s) specific for said reagent, and at least one of said DMR is located in a portion of the genome and/or a gene (in particular, when such genome and/or gene is a human genome or gene) selected from the group consisting of: a tumour suppressor gene, p16, SEPT9, RASSF1A, GSTP1. DAPK, ESR1, APC, HSD17B4 and H1C1. In particular, one of said DMR(s), or two or more DMRs, may be located in RASSF1A (eg SEQ ID NO. 13) such as located between about positions 4,700 bp and 5,600 bp of such RASSF1A; and/or said other region is located between about positions 14,220 bp and 13,350 bp of such RASSF1A. Other particular locations of the DMR(s) and/or other region(s) within RASSF1A for use in this embodiment are disclosed elsewhere herein. Furthermore, the person of ordinary skill will now recognise that other DMRs and/or other regions located in other portions of the genome of in other genes may be identified from the relevant scientific literature (eg, for review, see Elshimali 2013). In particular when used in the context of a medical condition being a tumour or cancer, the present invention includes embodiments where at least one or more (additional) other region(s) (preferably two or more) are located in a (eg human) housekeeping gene (such as GAPDH, beta-actin, ALB, APOE or RNASEP). Alternatively for such context, said (additional) other region(s) may be located in the same portion of the genome and/or gene that feature one or more DMRs (such as those p16, SEPT9, RASSF1A, GSTP1. DAPK, ESR1, APC, HSD17B4 and H1C1).

In yet another particular embodiment of the present invention, said species of DNA originates from a cell type associated with a medical condition selected from the group consisting of: an infection/infectious disease, a wasting disorder, a degenerative disorder, an (auto)immune disorder, kidney disease, liver disease, inflammatory disease, acute toxicity, chronic toxicity, myocardial infarction, and a combination of any of the forgoing (such as sepsis) and/or with a cell proliferative disorder, particularly in those embodiments where said species of DNA is circulating cell-free DNA and said sample is a blood fraction such as plasma or serum. For example, the medical condition may be an infection/infectious disease, such as one caused by a bacterial, viral or protozoan pathogen, including a pathogen selected from the group consisting of: a retrovirus (such as HIV), a herpes virus (such as HSV, EBV, CMV, HHV or VSV), dengue virus, mycobacteria (eg *Mycobacterium tuberculosis*), and hantavirus. In certain embodiments, the medical condition is sepsis and/or excludes kidney disease.

In all aspects of the present invention, there exist embodiments wherein the sample is a tissue sample or a sample of biological fluid. In particular, the sample is whole blood or a blood fraction (eg, such as plasma or serum). In alterative embodiments, the sample is biological fluid selected from the group consisting of: urine, saliva, sweat, ejaculate, tears, phlegm, vaginal secretion, vaginal wash and colonic wash. In more particular embodiments, the sample is a plasma or serum sample from the individual, or is urine from the individual. In other embodiments, the sample is largely (or essentially) free from cells, and/or is not a whole blood and/or ejaculate sample. In certain embodiments, the sample is not ejaculate if the individual is female and the sample is not a vaginal wash if the individual is male.

In all aspects of the present invention, the reagent that differentially modifies methylated and non-methylated DNA may comprise bisulphite and/or an agent that selectively digests unmethylated over methylated DNA (for example, such agent may digest unmethylated DNA but not methylated DNA). In particular embodiments, the reagent agent comprises: at least one methylation sensitive enzyme; at least one methylation sensitive restriction enzyme; and/or an agent selected from the group consisting of: AatII, AciI, AcII, AfeI, AgeI, AgeI-HF, AscI, AsiSI, AvaI, BceAI, BmgBI, BsaAI, BsaHI, BsiEI. BsiWI, BsmBI, BspDI, BsrFI, BssHII, BstBI, BstUI, ClaI, EagI, FauI, FseI, FspI, HaeII, HgaI, HhaI, HinP1I, HpaII, Hpy99I, HpyCH4IV, KasI, MluI, NaeI, NarI, NgoMIV, NotI, NotI-HF, NruI, Nt.BsmAI, Nt.CviPII, PaeR7I, PluTI, PmlI, PvuI, PvuI-HF, RsrII, SacII, SalI, SalI-HF, SfoI, SgrAI, SmaI, SnaBI, TspMI and ZraI. In particular embodiments, said reagent is one selected from the group consisting of: BstUI, HhaI and HpaII.

In related embodiments, the reagent may comprise two or more of any of the reagents disclosed herein. For example, it may comprise two, three, four, five or more (eg up to seven, eight or ten) methylation sensitive restriction enzymes, including a reagent comprising or essentially consisting of two or three of the methylation sensitive restriction enzymes selected from the group consisting of: BstUI, HhaI and HpaII The use of bisulphite or methylation-sensitive enzymes to study differential methylation will be well known to the person of ordinary skill, who may apply teachings of standard texts or adaptation of published methods such as Poon et al (2002), Nygren et al (2010) or Yegnasubramanian; et al (2006, Nuc Acid Res 34:e19). By way of illustration, the inventors provide examples herein that employ the use of methylation-sensitive restriction enzymes as the reagent that differentially modifies methylated and non-methylated DNA. For further illustration using bisulphite as reagent, it will be apparent to the person of ordinary skill that bisulphite-modified DNA methylation sites may be detected using eg methylation-specific PCR (such as using primers and/or probes that selectively bind to the bisulphite-modified sequences) and/or by the subsequent use of restriction enzymes the recognition site of which is created upon such bisulphite-modification. Methylation-specific PCR ("MSP") is described by Herman et al (U56200756, EP0954608 and related family members); and a further development of MSP using probe-based PCR (known as "MethylLight") is described by Laird et al (U56331393, EP1185695 and related family members).

In particular embodiments of all aspects of the invention, a quantitative amount of said species of DNA (and/or or said total DNA) is to be detected and/or determined. Accordingly in such embodiments, one or more (eg each) of said detection steps comprises quantitative detection and said detected amount of said species of DNA is expressed as a relative concentration of said species of DNA to the total DNA present in said sample.

If an absolute amount of total DNA is known, then correspondingly an absolute amount (for example, as represented by a concentration such as μg/mL or genome-equivalents such as Eg/mL) of the species of DNA can be determined from such relative concentration. An absolute amount of total DNA for a sample may be determined, for certain embodiments, by including the further steps of: detecting an amount of total DNA in a standard sample of DNA of known amount using the same other regions(s) as used in step (c); and comparing the signal detected from said standard sample of DNA to the signal detected in step (c). Such a standard sample of DNA (of known amount/concentration) is readily available from commercial sources, and especially if prepared and analysed using a dilution series, can readily and efficiently be used to determine (by interpolation/estimation from the standard curve) an absolute amount of total DNA present in the sample. Practically, such standard curve may be prepared and analysed essentially as described for the other regions (but in a separate set of standard vessels/reactions), preferably in the same run as the detection of the DMRs/other region(s); and may even use the same reaction master-mix. Accordingly, while the "DMR(s)" of the DNA control may be detected for such standard DNA, such a signal is not required to generate a standard curve. Accordingly, if the signal from a such a standard DNA sample is used to compare, the in certain embodiments where each of said detection steps comprises quantitative detection, said detected amount of said species of DNA can be expressed as an absolute amount of said species of DNA in said sample.

A determined quantitative amount of said species of DNA has utility in assessing the risk of the individual to certain medial conditions and/or if there is sufficient of such species of DNA in the sample to enable further analysis of such species of DNA to be conducted efficiently, accurately and/or in a cost effective manner.

Accordingly, certain embodiments of the present invention further include the step of: comparing the amount of said species of DNA detected with a threshold amount and/or reference distribution of amounts, wherein an increase in the (or outlying) amount of said species of DNA indicates an increased risk of the individual suffering from or developing a medical condition. Threshold amounts and/or a set of amounts to form a reference distribution may be obtained from published literature and or empirical studies. For example, using published threshold values (Papantoniou et al 2013, Prenat Diag 33:682) if the total cfDNA exceeds an amount of about 7,500 Eg/mL plasma or if the foetal cfDNA fraction exceeds an amount of about 500 Eg/mL plasma, then the woman may be determined to have such an increased risk. Such a risk may instead or additional be assessed by considering: (i) the fold-increase (eg 1.5, 3, 3.5 or 4-fold increase) of foetal cfDNA (determined for such woman compared to a threshold amount), factoring into the determination that for later-term pregnancies a higher fold-increase in foetal cfDNA may be utilised (Zeybek et al 2013, J Obstet Gynaecol Res 39:632); and/or (ii) into which percentile the amount of cfDNA determined from the woman falls, from consideration of a reference distribution of amounts such as those determined from low-risk women or those which did not suffer from or develop preeclampsia, for example if the foetal cfDNA fraction falls within the $90^{th}$ percentile of such a distribution, then the woman may be considered to have an increased risk of suffering mild or severe preeclampsia (Jakobsen et al 2013, Transfusion 53:1956). Other relevant factors may be considered in determining a suitable threshold amount. For example, a pregnant women who is also suffering from breast cancer, may have a higher bias of methylation at RASSF1A present in her plasma due to both factors.

Analogously, certain embodiments of the present invention further include the step of: comparing the amount of said species of DNA detected with a threshold amount and/or reference distribution of amounts, wherein an amount of said species of DNA in excess to said threshold (or is not an outlier compared to said population) indicates that a diagnosis for an abnormality in the said species of DNA present in said sample may be performed on, preferably a separate aliquot of DNA of, said sample. For example, if foetal cfDNA fraction is greater than about 10%, 9%, 8%, 7%, 6%, 5%, 4%, 3%, 2%, 1% or 0.5% of total cfDNA present in maternal plasma, then there would be sufficient fraction or foetal cfDNA to effectively conduct a subsequent test to investigate one or more characteristics of the foetal cfDNA, for example to investigate the chance or existence of a chromosomal anomaly of mutation comprised within such foetal cfDNA (such as using NIPT based on massively parallel sequencing). In the case of twin pregnancies, the inventors determine that a minimum foetal fraction of cfDNA for NIPT of a twin pregnancy could be considered to be 8%, or about 5%, 6%, 7%, 9% or 10%, and for monochorionic twin pregnancies with concordant genotypes (apart from rare exceptions, Chen et al, 2013, Am J Med Genet A, 161A:1817), a foetal cfDNA fraction of 4%, or about 2%, 3% or 5%, would be sufficient. In certain embodiments, the threshold amount(s) may be established by a standard control; for example, established experimentally from a known sample (or a plurality of known samples) once or separately, and/or a threshold amount(s) that is established (eg a from a sample or plurality of known samples) at about the same time as the test sample (or test samples), such as in the same run, in particularly by establishing the threshold amount(s) by practicing a method of the present invention on samples contained in wells of a microtitre plates where one or more known samples placed in one or more (separate) wells and one or more test samples placed in other wells. In other embodiments of the present invention, a comparison with a threshold amount and/or reference distribution of amounts is made from the relative amount (such as the ratio of) the amount of a first species of DNA to the amount of second species of DNA. For example, an amount of a first species of DNA originating from a normal diploid set of human chromosomes 21 would be expect to show about a 2:2 (ie 1:1) ratio to the amount of a second species of DNA originating from a reference (diploid) set of eg chromosome 2. However, in the event of trisomy 21, such a ratio would be expected to be about 3:2. As will now be understood by the person of ordinary skill, other chromosomal (or partial chromosomal) aneuploidies would be expect to show other ratios, for example 1:2 in the case of a loss of a complete chromosome, or a partial loss such as a partial deletion of the location of the first species of DNA, compared to the reference chromosome comprising the location of the second species of DNA. In certain embodiments, eg if not differentiated such as by methylation differences, the presence of other DNA (ie in a mixture with such other DNA) such as euploid maternal cfDNA in admixture with aneuploid foetal cfDNA could result in modified such ratios depending on the relative amounts of (euploid) maternal and (aneuploid) foetal cfDNAs. As will also be understood by the person or ordinary skill, modified such ratios may result from other factors such as the relative reaction (eg PCR reaction) efficiency of each amplicon. Accordingly, in certain of such embodiments, the threshold amount is a ratio that is (detectably and/or significantly) greater or smaller than 2:2 (100%) such as about 3:2 (150%), about 2:3 (66%), about 1:2 (50%) or about 2:1 (200%); including threshold amounts and/or ratios that are greater than about 200%, less than about 50%, or is one selected from the list consisting of about: 190%, 180%, 170%, 160%, 150%, 140%, 130%, 120%, 110%, 105%, 95%, 90%, 85%, 80%, 75%, 70%, 65%, 60%, and 55%. Alternatively, in particular embodiments, the threshold amount may be determined merely by there being no detectable amount of the first (or second) species of DNA, such as in Turners syndrome (a human female with a "45, X" karyotype rather than the fully euploid "46, XX" karyotype).

Comparing and detecting differences between sample distributions and reference distributions, or sample outliers from reference distributions will be known to the person of ordinary skill, and include the use of parametric and non-parametric statistical testing such as the use of (one- or two-tailed) t-tests, Mann-Whitney Rank Sum test and others, including the use of a z-score, such as a Median Absolute Deviation based z-score (eg, such as used by Stumm et al 2014, Prenat Diagn 34:185). When comparing a distribution to (or outliers from) a reference distribution, then in certain embodiments of the invention, the comparison is distinguished (and/or identified as being significantly different) if the separation of the means, medians or individual samples are greater than about 1.5, 1.6, 1.7, 1.8, 1.9, 1.95, 1.97, 2.0, or greater than about 2.0 standard distributions ("SD") of the reference distribution; and/or if an individual sample separates from the reference distribution with a z-score of greater than about 1.5, 1.6, 1.7, 1.8, 1.9, 2.0, 2.5, 2.7, 2.8, 2.9, 3.0, 3.1, 3.2, 3.3, 3.4, 3.5, 3.75, 4.0, 4.5, 5.0 or greater than about 5.0.

In certain embodiments, a parameter (such as a mean, median, standard deviation, median absolute deviation or z-score) is calculated in respect of a set of samples within each run, plate or detection/analysis data-set. In certain of such embodiments, such a calculated parameter is used to identify outliers (such as trisomy samples) from those test samples detected/analysed in such run, plate or data-set (eg, a "run-specific" analysis). In particular embodiments, such a parameter is calculated from all test samples without knowledge of the identity of any outliers (eg a "masked" analysis). In other particular embodiments, such a parameter is calculated from a set of reference samples know to be (non-outlying) standards (such as samples known to contain cfDNA from euploid foetuses) or test samples that are presumed to be (or are unlikely to be) such standards.

In certain embodiments, in the context of a data set a z-score (or an equivalent statistic based on the distribution pattern of replicates of a parameter) may be calculated to identify an outlying data point(s) (for example, representing an excessive amount of the species of DNA such as in the context of a test seeking to identify a pregnant female predicted to have or having an increased risk of suffering or developing preeclampsia, or representing an excessive amount of one chromosome over a reference chromosome such as in the context of a test seeking to identify a foetus suffering from a chromosomal aneuploidy), the data representing such data point removed from the data set and a subsequent z-score analysis be conducted on the data set to seek to identify further outliers. Such an iterative z-score analysis may be particular helpful in detection of foetal chromosomal aneuploidies using a method of the present invention, where sometimes two or more aneuploidy samples in one run may skew a single z-score analysis, and/or where follow-up tests are available to confirm false positives and hence avoiding false negatives is potentially more important that the (initial) identification of false positives.

Accordingly, one other aspect of the present invention relates to a method to identify at least one sample as an outlier from a set of samples each from an individual, said method comprising the steps: (i) calculating an absolute or relative amount of said species or DNA in each sample of said set using a method of the present invention (such as the first, second or further aspects); (ii) calculating a mean (or median) and a standard deviation (or a median absolute deviation for said amount in respect of all samples in the set; (iii) conducting a z-score analysis on all samples in the set; (iv) identifying any samples with a z-score of greater than about 1.7; (v) repeating steps (ii) to (iv) at least one more time, each time removing from the calculations of step (ii) any data in respect of additional samples with a z-score of greater than about 1.70. In certain embodiments of such aspect, the z-score is greater than about 1.75, 1.80. 1.85, 1.90, 1.95, 2.00, 2.05, 2.10, 2.15, 2.20, 2.25, 2.30, 2.35, 2.40, 2.45 or 2.50; and/or steps (ii) to (iv) are repeated two, three, four, five or between five and about eight more times. In particular embodiments, steps (ii) to (iv) are repeated until no further samples are identified as outliers. In one embodiment of such aspect, the z-score cut-off is raised (such as by about 0.05, 0.10, 0.15, 0.20, 0.25, 0.30, 0.35, 0.40, 0.45 or 0.50) in each repeated set of steps. In certain embodiments of such aspect, the amount of said species of DNA is a relative amount of total foetal cfDNA and the outlying sample(s) represent a pregnant female with an increased risk of developing a medical condition such as preeclampsia, preterm labour, intrauterine growth retardation or vanishing twin (in particular, preeclampsia). In certain embodiments of such aspect, the amount of said species of DNA is a relative amount of a first species of foetal cfDNA located on a chromosome relevant to the chromosomal aneuploidy or within a section of a chromosome relevant to the chromosomal aneuploidy to a second species of foetal cfDNA located on a reference chromosome, and the outlying sample(s) represent a pregnant female with an increased risk of carrying a aneuploid foetus (such as a foetus with trisomy 21, trisomy 18 or trisomy 13). As will now be appreciated by the person of ordinary skill, an corresponding such aspect would include where an outlier is identified if the z-score is less than a negative cut-off, such as less that about −1.7. A related other aspect of the present invention relates to a computer program product comprising a computer readable medium encoded with a plurality of instructions for controlling a computing system to perform and/or manage an operation for conducting at least steps (ii) to (v) of the preceding aspects. In certain embodiments, such program product further comprises instructions for controlling a computing system to perform and/or manage an operation for conducting step (i).

Therefore, the present invention also includes embodiments where comprising a further step of: performing on, preferably with a separate aliquot of DNA of, said sample an in-vitro diagnosis for an abnormality in said species of DNA present in said sample; preferably wherein, said species of DNA originates from cells of a foetus and/or the placenta of a foetus, said sample is from a pregnant female and said diagnosis is a prenatal diagnosis. Such diagnosis directed at said species of DNA present may comprise a step that uses a detection technology selected from the group consisting of: DNA sequencing, SNP analysis, digital PCR and hybridization, and in particular embodiments said detection technology is massively parallel sequencing of DNA, such as massively parallel sequencing of random and/or (exon) enriched DNA. In certain embodiments of the present invention, such an in-vitro diagnosis is conducted on the same aliquot of DNA. For example, a method of the present invention may be conducted (or modified to so conduct) so as to enable such a diagnosis from the practice of such a method without the need for a further detection technology. Such methods provide particularly advantageous solutions to solve the need or more rapid, simpler and less expensive approaches to provide such diagnostic tests. Particular aspects and/or embodiments of the present invention that provide for such advantageous solutions are described herein.

Such a diagnosis or test may be directed at the foetal DNA to identify a genetic mutation or chromosomal abnormality of the foetal DNA. Accordingly in certain embodiments, said species of DNA originates from cells of a foetus and/or the placenta of a foetus, said sample is from a pregnant female and said abnormality is a genetic mutation or a chromosomal abnormality, such as a chromosomal trisomy, associated with a foetal abnormality and/or a congenital disorder, In particular such embodiments, the genetic mutation is selected from the group consisting of: colour blindness, cystic fibrosis, hemochromatosis, haemophilia, phenylketonuria, polycystic kidney disease, sickle-cell and disease, Tay-Sachs disease; and/or the chromosomal abnormality is selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis. In other embodiments, the genetic mutation or chromosomal abnormality may be one or more selected from those having a clinical utility gene cards (CUGCs) of the EuroGentest2 initiative (www.eurogentest.org). In particular embodiments, the chromosomal abnormality is a trisomy (such as trisomy 21, trisomy 18, or trisomy 13), a sex-chromosome abnormality or a chromosomal deletion.

Such diagnosis or test may be directed at a species DNA to identify a genetic mutation or chromosomal abnormality of such DNA that is derived from a cell or cell-type associated with a medical condition. Accordingly in one of such embodiments, said species of DNA originates from cells of a tumour and said abnormality is a genetic mutation or a chromosomal abnormality associated with the diagnosis, prognosis or predictive treatment of a carcinoma or cancer. In particular such embodiments, the genetic mutation is selected from the group consisting of: a mutation in a tumour suppressor gene (such as TP53 (p53), BRCA1, BRCA2, APC or RB1), a mutation in a proto-oncogene (such as RAS, WNT, MYC, ERK, or TRK) and a DNA repair gene (such as HMGA1, HMGA2, MGMT or PMS2); and/or the chromosomal abnormality is a translocation (such as t(9;22)(q34;q11) [ie, Philadelphia chromosome or BCL-ABL], t(8;14)(q24;q32), t(11;14)(q13;q32), t(14;18)(q32;q21), t(10;(various))(q11;(various)), t(2;3)(q13;p25), t(8;21)(q22;q22), t(15;17)(q22;q21), t(12;15)(p13;q25), t(9;12)(p24;p13), t(12;21)(p12;q22), t(11;18)(q21;q21), t(2;5)(p23;q35), t(11;22)(q24;q11.2-12), t(17;22), t(1;12)(q21;p13), t(X;18)(p11.2;q11.2), t(1;19)(q10;p10), t(7,16)(q32-34;p11), t(11,16)(p11;p11), t(8,22)(q24;q11) or t(2;8)(p11;q24)).

In particular embodiments of the present invention:
the presence of methylated DNA at a first DMR (or a first set of two or more DMRs), for example detected in a detection step (b) of a method of the present invention, is used to indicate the presence of an amount of a first species of DNA in said sample and the absence of methylated DNA at said first DMR (or first set of DMRs) indicates the absence of said first species of DNA in said sample; preferably wherein, said first species of DNA originates from cells of a foetus and/or the placenta of a foetus (for example, from a chromosome relevant to a chromosomal aneuploidy such as human chromosome 21), said sample is from a pregnant female and at least one of said first DMR (first set of DMRs) is one as set forth herein; and
the presence of methylated DNA at a second DMR (or second set of two or more DMRs)), for example detected in the same or different a detection step (b) of a method of the present invention, is used to indicate the presence of an amount of a second species of DNA in said sample and the absence of methylated DNA at said second DMR (or second set of DMRs) indicates the absence of said second species of DNA in said sample; preferably wherein, said second species of DNA originates from cells of a foetus and/or the placenta of a foetus, said sample is from a pregnant female and at least one of said second DMR (or second set of DMRs) DMR is one set forth herein; and
a first amount of total DNA present in said sample is detected, for example in a detection step (c) of a method of the present invention, using a first region that is not differently methylated between said first species of DNA and the DNA not originating from cells of said type, the modification of which first other region by said reagent is insensitive to methylation of DNA, wherein said first other region is located between about 20 bp and about 20 kb upstream or downstream of said first DMR (or at least one of first set of DMRs); and a second amount of total DNA present in said sample is detected, for example in the same or different a detection step (c) of a method of the present invention using a second region that is not differently methylated between said second species of DNA and the DNA not originating from cells of said type, the modification of which second other region by said reagent is insensitive to methylation of DNA, wherein said second other region is located between about 20 bp and about 20 kb upstream or downstream of said second DMR (or at least one of said second set of DMRs).

By way of graphical description, a schematic representation of the general arrangement of the DMR(s), the other region(s) and the detectable label(s), as used for such an embodiment of the first aspect of the present invention, is presented in FIG. 6. (1) The presence of methylation in a first species of DNA (such as a particular chromosome for example human chromosome 21) at DMR1 is detected in the context of an other region ("OR1") which is located within the same portion of the genome (eg, between about 20 bp and about 20 kb upstream or downstream of) DMR1. (2) Optionally, additional DMRs and/or ORs (such as DMR2 and/or OR2, and up to DMRn and ORn) may be detected, and pairs of such additional DMRs and ORs may each be co-located in a same portion of the genome (eg, between about 20 bp and about 20 kb upstream or downstream of) as each other, and in each case all detecting the same first species of DNA (such as the same chromosome for example human chromosome 21). Optionally, (3) the presence of methylation in such first species of DNA is detected at multiple DMRs, using the same detectable label(s) and/or (4) the first amount of total DNA detected using at least one OR (OR1, and optionally, OR2 or up to ORn) is detected using different detectable label(s) to those used to detect methylation at the DMR(s) representing the first species of DNA (optionally, the detectable label(s) used is the same for all the ORs). (1') In such an embodiment, the first species of DNA is detected, identified and/or quantified in comparison to that of a second species of DNA (such as a reference chromosome for example human chromosome 2). Such second species of DNA is detected as described for first species of DNA, but using different DMR(s) and OR(s)—represented by the "prime" after each on the figure, and with reference to the explanatory labels. In those of such embodiments where the detection of DMR(s), OR(s), DMR(s)' and OR(s)' are made using the same aliquot of DNA of said sample, in the same reaction/detection vessel, and/or effectively simultaneously with each other (for example by multiplex real-time quantitative probe-based PCR as described herein, such as by using at least one labelled probe specific for each of said DMR(s) and other regions(s))), then such embodiments include those where the detectable label(s) (3), (4), (3)' and (4)' are different, and/or can be separately detected and/or quantified.

Figure 7:
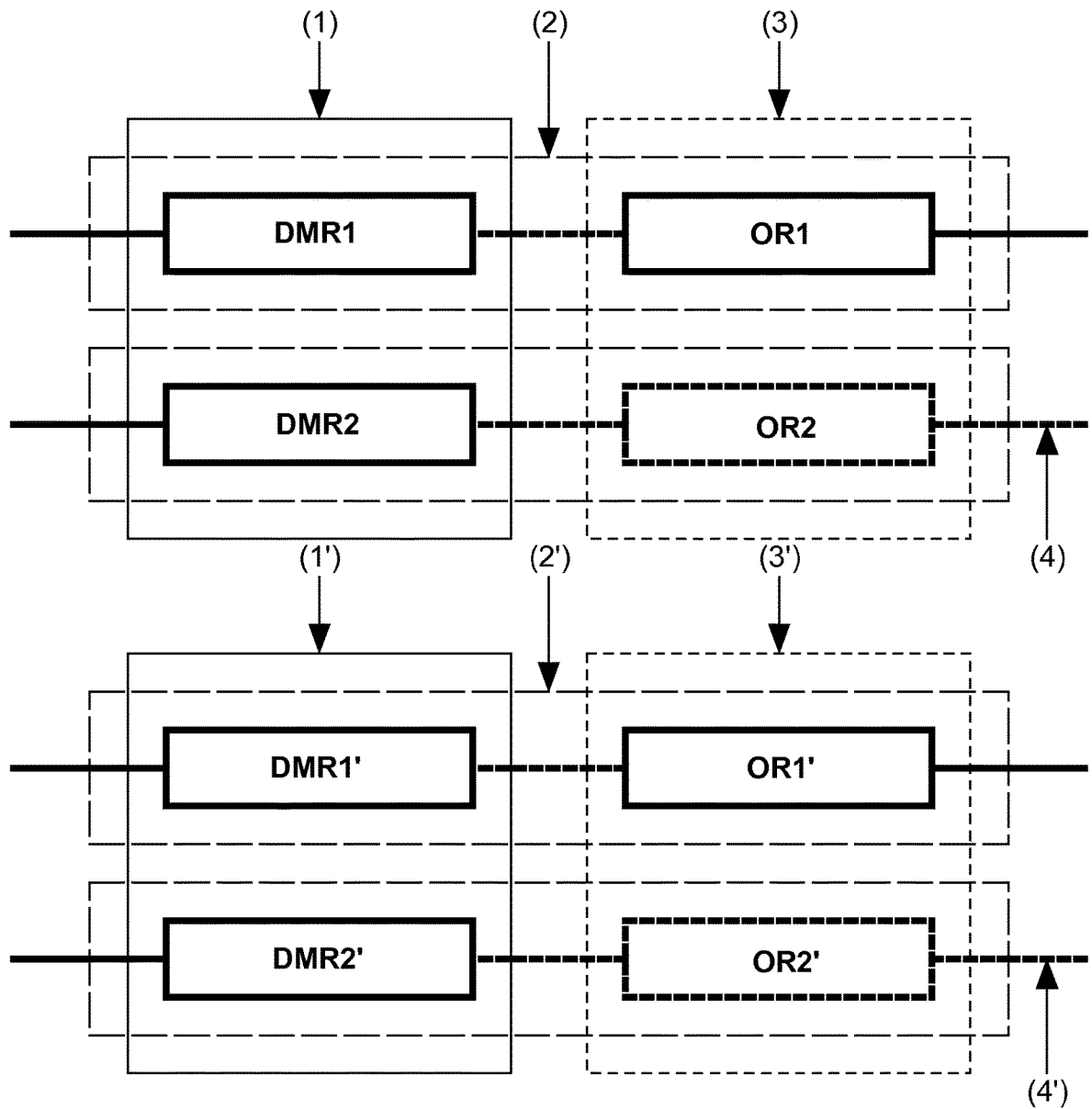
FIG. 7 depicts a schematic representation of the differentially methylated regions ("DMR") and other regions ("OR") based on a method of the second aspect of the present invention.

By way of graphical description, a schematic representation of the general arrangement of the DMRs, the other region(s) and the detectable label(s), as used for such an embodiment of the second aspect of the present invention, is presented in FIG. 7. (1) The presence of methylation in a first species of DNA (such as a particular chromosome for example human chromosome 21) at two or more DMRs, DMR1 and DMR2 (and, optionally, up to DMRn), is in each case detected using the same detectable label(s). (2) Optionally, an other region ("OR") which is located within a same portion of the genome (eg, between about 20 bp and about 20 kb upstream or downstream of) one of the DMRs. (3) The first amount of total DNA detected using at least one OR (OR1, and optionally, OR2 or up to ORn) is detected using different detectable label(s) to those used to detect methylation at the DMRs (optionally, the detectable label(s) used is the same for all the ORs). (4) Optionally, methylation at more than two DMRs is so detected, and/or the first amount of total DNA is detected at more than one OR. (1') In such an embodiment, the first species of DNA is detected, identified and/or quantified in comparison to that of a second species of DNA (such as a reference chromosome for example human chromosome 2). Such second species of DNA is detected as described for first species of DNA, but using different DMRs and, optionally, ORs—represented by the "prime" after each on the figure, and with reference to the explanatory labels. In those of such embodiments where the detection of DMR(s), OR(s), DMR(s)' and OR(s)' are made using the same aliquot of DNA of said sample, in the same reaction/detection vessel, and/or effectively simultaneously with each other (for example by multiplex real-time quantitative probe-based PCR as described herein, such as by using at least one labelled probe specific for each of said DMR(s) and other regions(s))), then such embodiments include those where the detectable label(s) (3), (4), (3)' and (4)' are different, and/or can be separately detected and/or quantified.

The practice of such a method as described in the previous paragraphs, can enable the relative detection (or amount) of the first species of DNA (for example, from a chromosome, or part thereof, related to a chromosomal aneuploidy such as human chromosome 21) and the second species of DNA (for example, from a reference chromosome, or part thereof, such as chromosome 2), and hence aid the rapid, simple and cost-effective detection, identification or diagnosis of chromosomal abnormalities, such as a chromosomal aneuploidy in a foetus. Such an approach may be more easily established and practiced in many laboratories, requiring for example, a relatively simple, reliable and cost-effective quantitative PCR machine; and not requiring expensive and specialised high-throughput next-generation sequencing machines. Indeed, in certain of such embodiments of the present invention, detection in step (b) of said first and second DMR (or set of DMRs) and said detection in step (c) of said first and second other regions are made using the same aliquot of DNA of said sample, and in the same reaction/detection vessel, and effectively simultaneously for such DMRs and other regions, and using: (x) a different detectable label(s) for each of said first and second DMR (or set of DMRs); and (y) further different detectable label(s) for each of said first and second other regions. The relative detection, identification or quantification of the first and the second species of DNA (via the first (set of) DMR(s) and the second (set of) DMR(s)) is, in those embodiments conducted in the same reaction/detection vessel and effectively simultaneously, advantageously made by the use of detectable labels that can distinguish the first from the second (set of) DMRs and their corresponding first and second other regions. In a particular further such embodiment where detection (b) and (c) is conducted in the same reaction/detection vessel and effectively simultaneously includes where said detection in step (b) and said detection in step (c) are made by multiplex real-time quantitative probe-based PCR using at least one labelled probe specific for each of said DMRs and other regions.

In all embodiments of the present invention, particularly those detecting a plurality (such as two or more) species of DNA in the sample, the agent may comprise at least one methylation sensitive restriction enzyme, such as one or more of those described elsewhere herein. Alternatively, or additionally, in such embodiments the agent may comprise bisulphite, particular for those methods that utilise MSP or MethylLight detection approaches as described herein.

In all embodiments of the present invention, particularly those detecting a plurality (such as two or more) species of DNA in the sample, one or more (preferably each) of said detection steps comprises quantitative detection. For example, in certain embodiments, said detected amount of each of said species of DNA is expressed as a relative concentration of said species of DNA to the respective amount of total DNA detected in said sample from the respective other region. In further of such embodiments, the methods of the present invention can further comprise the steps of detecting an amount of total DNA in a standard sample of DNA of known amount using the same other regions as used in step (c); and comparing the signal detected from said standard sample of DNA to the respective signal detected in step (c) for each of the other regions. In alterative certain embodiments, one or more (preferably each) of said detection steps comprises quantitative detection and said detected amount of said species of DNA is expressed as an absolute amount of each or said species of DNA in said sample.

In those embodiments of the present invention that quantitatively detect a plurality (such as two or more) species of DNA in the sample, such methods can further comprise the steps of:
  determining the relative amount, preferably a ratio, of: (x) said first species of DNA detected with the first DMR (or first set of two or more DMR); and (y) said second species of DNA detected with the second DMR (or first set of two or more DMRs); and
  comparing said relative amount or ratio with a threshold and/or reference distribution of amount(s) or ratio(s), wherein: a relative amount or ratio that is higher or lower than said threshold and/or reference distribution of amount(s) or ratio(s) indicates the presence of an abnormality in said first and/or second species of DNA present in said sample.

Such embodiments are particularly preferred when the presence of the abnormality to be indicated by the method is a chromosomal abnormality such as a chromosomal abnormality is associated with a foetal abnormality and/or congenital disorder. For example, such a chromosomal abnormality may be selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis. Of most relevance, in terms of prevalence and hence medical and social significance is where the chromosomal abnormality is a trisomy, such as one selected from the list consisting of trisomy 21, trisomy 18, or trisomy 13.

One further aspect of the present invention relates to a method for detecting a chromosomal aneuploidy in a foetus carried by a pregnant female, said method comprising the steps:
(A) Determining, using a method of the present invention (such as a method of the first and/or second aspect of the invention) in any of the embodiments described herein (or others), in a sample taken from said pregnant female the amount of a first species of DNA that originates from cells of a foetus and/or the placenta of a foetus, wherein said first species of DNA is located on a chromosome relevant to the chromosomal aneuploidy or within a section of a chromosome relevant to the chromosomal aneuploidy, and wherein said first species of DNA that originates from cells of a foetus and/or the placenta of a foetus is distinguished from its counterpart of maternal origin in the sample due to differential DNA methylation;
(B) Determining, using a method of the present invention (such as a method of the first and/or second aspect of the invention) in any of the embodiments described herein (or others), the amount of a second species of DNA that originates from cells of a foetus and/or the placenta of a foetus in said sample, wherein said second species of DNA is located on a reference chromosome, and wherein said second species of DNA that originates from cells of a foetus and/or the placenta of a foetus is distinguished from its counterpart of maternal origin in the sample due to differential DNA methylation;
(C) determining the relative amount, preferable the ratio, of the amounts from (A) and (B); and
(D) comparing said relative amount or ratio with a threshold and/or reference distribution of amount(s) or ratio(s), wherein: a relative amount or ratio that is higher or lower than said, threshold and/or reference distribution of amount(s) or ratio(s) indicates the presence of the chromosomal aneuploidy in the foetus.

In such further aspect, said amount of the first species of DNA and said amount of the second species of DNA is determined using a method of the first and/or the second aspect of the invention (or any embodiments thereof). Accordingly, when using a method of the first aspect of the present invention, the amount of the first species of DNA may be determined by the use (in step (b) of such method) of one or more DMRs and the use (in step (c) of such method) of at least one OR; wherein the OR is located between about 20 bp and about 20 Kb upstream or downstream of said DMR; and in this further aspect wherein the other region and the DMR are located on a chromosome relevant to the chromosomal aneuploidy or within a section of a chromosome relevant to the chromosomal aneuploidy. Alternatively, when using a method of the second aspect of the present invention, the amount of the first species of DNA may be determined by the use (in step (b) of such method) of two or more DMRs and the use (in step (c) of such method) of at least one OR; wherein said detection in such step (b) and said detection in such step (c) are made using the same aliquot of DNA of said sample, and in the same vessel, and effectively simultaneously for such DMRs and other region(s), and using: (x) the same detectable labels(s) for each of said DMRs; and (y) a different detectable label(s) for said other region(s); and where at the least the two DMRs are located on a chromosome relevant to the chromosomal aneuploidy or within a section of a chromosome relevant to the chromosomal aneuploidy. In respect of each such alternative, examples of suitable DMRs and other regions that are located on such chromosome or chromosomal region are described elsewhere herein, and such examples are specifically encompassed in embodiments of such further aspect. As will be now understood by the person of ordinary skill, the amount of the second species of DNA may be determined using a method of the first or second aspect of the invention; analogously to that for the determination of the amount of the first species of DNA as just described, except that the DMR(s) (and at least one OR if the method of the first aspect of the invention used for such determination) are located on a reference chromosome. Hence, also included in this further aspect are embodiments that use DMRs and/or ORs described elsewhere herein as being located on such a reference chromosome. The use of a method of either the first or second aspect of the present invention to determine the amount of the first species of DNA in step (A) of this further aspect and/or the amount of the second species of DNA in step (B) of this further aspect, provides that the amount(s) of such species of DNA to be more suitably determined (eg with more accuracy and/or precision) than merely by determination of an amount based only prior-art methods, such as only on a single DMR.

A schematic representation of the differentially methylated regions ("DMR") and other regions ("OR") that may be used for such further aspect and based on a method of the first aspect of the present invention, is shown by FIG. 6, and as described above. Correspondingly, an alternative schematic representation of the differentially methylated regions ("DMR") and other regions ("OR") that may be used for such further aspect and based on a method of the second aspect of the present invention, is shown by FIG. 7, and as described above.

An alternative aspect related to the second aspect of the present invention relates to an alternative method for detecting in a sample from an individual an amount of a species of DNA originating from cells of a given type, which sample comprises said species of DNA in admixture with differentially methylated DNA not originating from cells of said type; said method comprising the steps:
(a) treating the DNA present in said sample with a reagent that differentially modifies methylated and non-methylated DNA; and
(b) detecting in said sample the presence of methylation in said species of DNA at two or more DMRs that are differently methylated between said species of DNA and the DNA not originating from cells of said type the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample,
wherein, said detection in step (b) is made using the same aliquot of DNA of said sample, and in the same reaction/detection vessel, and effectively simultaneously for such DMRs, and using (x) multiplex real-time quantitative PCR; and (y) at least two labelled probes each of which specific for one of said DMRs and that are labelled with the same detectable label(s) for each of said DMRs. Such an alternative method of the present invention is not intended to be practiced on the human or animal body; for example it is intended to be practiced in an in-vitro manner. Further characterisation of any of the features of this alternative method of the present invention (or any combination of such features) can include the characterisations (and their combinations) as described elsewhere herein in respect of the first aspect of the invention. In particular embodiments of this alternative method of the present invention, the reagent comprises one or more methylation sensitive restriction enzyme, such as one (or a combination thereof) as disclosed herein.

In an additional aspect, the invention relates to a method for detecting an increased risk of an individual suffering from or developing a medical condition, said method comprising the steps:

(i) conducting a method of the present invention that determines a quantitative amount said species of DNA (and/or total DNA) in the sample; and
(ii) comparing the amount of said species of DNA detected with a threshold amount and/or a reference distribution of amounts,
wherein an increase in the (or outlying of) amount of said species of DNA (and/or total DNA) indicates an increased risk of the individual suffering from or developing said medical condition.

A further additional aspect of the invention relates to a composition (eg, one that is useful for, or used in, a method of the present invention), said inventive composition comprising, either (1):
one pair of PCR primers for amplifying one of said DMRs as set forth anywhere herein;
one pair of PCR primers for amplifying said other region as set forth anywhere herein;
one labelled probe for quantitative probe-based PCR, which specific for said DMR; and
one labelled probe for quantitative probe-based PCR specific for said other region and labelled with different detectable label(s) to the probe used for said DMR; or
(2);
two pairs of PCR primers, each pair for amplifying one of said two of more DMRs as set forth anywhere herein;
one pair of PCR primers for amplifying said other region as set forth anywhere herein;
two labelled probes for quantitative probe-based PCR, each of which specific for one of said DMRs, and labelled with the same detectable labels(s) for each of said probe; and
one labelled probe for quantitative probe-based PCR specific for said other region and labelled with different detectable label(s) to the probes used for said DMRs.
Such a composition of the present invention may further comprise, either (1):
a further pair of PCR primers for amplifying a second DMR as set forth anywhere herein; and a further labelled probe for quantitative probe-based PCR specific for said DMR and labelled with detectable label(s), optionally that is the same as that used for the probe(s) specific the first other region; and/or
a further pair of PCR primers for amplifying a second other region as set forth anywhere herein; and a further labelled probe for quantitative probe-based PCR specific for said other region and labelled with detectable label(s) that is different to those used probes for said DMRs; and optionally that is the same as that used for the probe(s) specific the first other region; or (2).
a further pair of PCR primers for amplifying a second other region as set forth anywhere herein; and
a further labelled probe for quantitative probe-based PCR specific for said other region and labelled with detectable label(s) that is different to those used probes for said DMRs; and optionally that is the same as that used for the probe(s) specific the first other region.

A yet further additional aspect of the invention relates to a kit (for example a kit of separate components; such as a kit of holders or vessels, each holding a different component of the kit), such kit comprising a set of primers and probes as comprised in a composition of the present invention. A kit of the present invention may comprise additional components. For example, the kit may additionally comprise: (i) a printed manual or computer readable memory comprising instructions to use said primers and probes, including to use them to practice a method of the present invention and/or to produce or use a composition of the present invention; and/or (ii) one or more other item, component or reagent useful for the practice of a method of the present invention; and/or the production or use of the composition of the present invention, including any such item, component or reagent disclosed herein, such as a reagent that differently modifies methylated and non-methylated DNA as set forth anywhere herein.

In particular embodiments of the composition or the kit, one or more of the primers or probes comprised therein comprises (or consists of) a primer or probe sequence selected from one set forth in TABLE 1 and/or TABLE 8. In certain of such embodiments, the composition or the kit comprises the pair or primers and a probe as set forth in TABLE 1 for each of (x) one of the DMRs; and (y) one of the ORs; and in further such embodiments, the pair or primers and a probe as set forth in TABLE 1 for all of (x) the two the DMR; and (y) the two ORs set forth therein. In alternative such embodiments, the composition or the kit comprises the pair or primers and a probe as set forth in TABLE 8 for all of (x) the two the DMR; and (y) the two ORs set forth therein. In any of such embodiments, the probes may be labelled with the label/quencher (and optionally a minor grove binding moiety) as set forth in the respective table for such probe.

Another further aspect of the invention relates to a computer program product comprising a computer readable medium encoded with a plurality of instructions for controlling a computing system to perform and/or manage an operation for determining: (x) an increased risk of an individual suffering from or developing a medical condition and/or (y) if a diagnosis for an anomaly in a species of DNA originating from cells of a given type may be performed, in each case from a sample from an individual comprising a species of DNA originating from cells of a given type in admixture with differently methylated DNA not originating from cells of said type, the DNA in present in said sample being treated with a reagent that differentially modifies methylated and non-methylated DNA as set forth herein; said operation comprising the steps of:

receiving: (i) one signal representing the (essentially simultaneous) quantitative detection of methylation at one or more (or two or more) DMRs as set forth in step (b) as described anywhere herein; and (ii) one signal representing the (essentially simultaneous) quantitative detection of total DNA using at least one other region as set forth in step (c) as described anywhere herein;

determining a parameter from the signals (i) and (ii), wherein the parameter represents a quantitative amount of said species of DNA (and/or said total DNA);

comparing the parameter to with a threshold amount and/or reference distribution of amounts; and based on such comparison, determining a classification of whether, respectively, (x) an increased risk of an individual suffering from or developing a medical condition exists; and/or (y) a diagnosis for an anomaly in a species of DNA originating from cells of a given type may be performed.

In certain embodiments, a computer program product of the present invention the operation further comprises steps of: receiving a further signal representing the quantitative detection of total DNA in a standard sample of DNA as set forth anywhere else herein; and comparing said signal with the signal representing the essentially simultaneous quantitative detection of total DNA using at least one other region, so as to determine said parameter that represents an absolute quantitative amount of said species of DNA.

In particular embodiments, the computer program product of the present invention is for an operation for determining if a diagnosis for an anomaly in said species of DNA may be performed, and said operation further comprises the step of determining from said parameter a number of random and/or enriched DNA molecules to be sequenced from, preferably from a separate aliquot of DNA of, said sample as part of said diagnosis.

In other particular embodiments, the computer program product of the present invention is for an operation that further comprises the steps of:

receiving: (i) one signal representing the quantitative detection of methylation at a second DMR (or set of two or more DMRs) as set forth in step (b) above; and (ii) one signal representing the quantitative detection of total DNA using a second other region as set forth in step (c) above;

determining a second parameter from the signals (i) and (ii), wherein the parameter represents a quantitative amount of said second species of DNA;

determining the relative amount, preferable the ratio, of said parameter and said second parameter;

comparing said relative amount or ratio with a threshold and/or reference distribution of amount(s) or ratio(s); and based on such comparison, determining a classification of whether an abnormality in said species of DNA or second species of DNA present in said sample Such embodiments of the computer program product are particularly preferred when the presence of the abnormality to be indicated by the method is a chromosomal abnormality such as a chromosomal abnormality is associated with a foetal abnormality and/or congenital disorder. For example, such a chromosomal abnormality may be selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis. Of most relevance, in terms of prevalence and hence medical and social significance is where the chromosomal abnormality is a trisomy, such as one selected from the list consisting of trisomy 21, trisomy 18, or trisomy 13, in particular trisomy 21.

Figure 5:
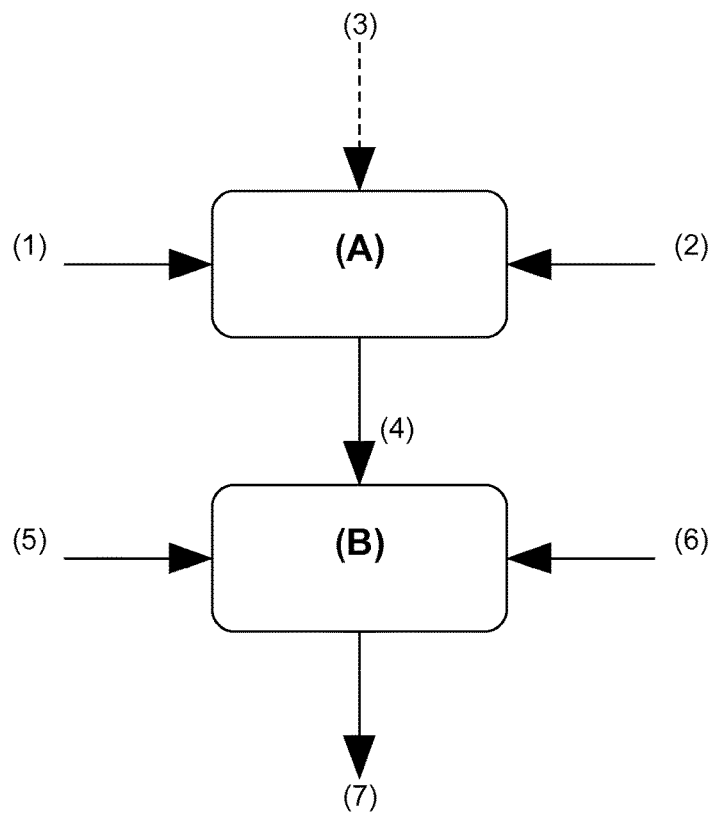
FIG. 5 depicts a schematic representation of the operations conducted by a computer program product of the invention.

One embodiment of operations performed and/or controlled by the computer program product of the invention is depicted in FIG. 5. Operation (A) receives signals (1) and (2) that represent, respectively, the methylation at the DMR(s) and the total DNA, and optionally signal (3) then represents an amount of total DNA from a standard sample. Operation (A) determines a parameter (4) from signals (1), (2) and optional (3) that represents a relative or absolute amount of DNA (eg from foetal vs total DNA). This parameter (4) is compared by operation (B) against a threshold amount (5) and/or a reference population of amounts (6) so as to classify (7) the risk of an individual suffering from a medial condition and/or if a diagnosis for an anomaly in either of the DNA in the sample may be performed.

It is to be understood that application of the teachings of the present invention to a specific problem or environment, and the inclusion of variations of the present invention or additional features thereto (such as further aspects and embodiments), will be within the capabilities of one having ordinary skill in the art in light of the teachings contained herein.

Unless context dictates otherwise, the descriptions and definitions of the features set out above are not limited to any particular aspect or embodiment of the invention and apply equally to all aspects and embodiments which are described.

All references, patents, and publications cited herein are hereby incorporated by reference in their entirety.

Certain aspects and embodiments of the invention will now be illustrated by way of example and with reference to the description, figures and tables set out herein. Such examples of the methods, uses and other aspects of the present invention are representative only, and should not be taken to limit the scope of the present invention to only such representative examples.

Example 1: Use of the Method of the Invention in NIPT in Multiple Pregnancies, Including in Cases of Vanishing Twins Sample collection, processing and DNA extraction:

36 blood samples from women pregnant with multiple gestations (mono-, di- and trichorionic twin and triplet pregnancies) were collected between Nov. 6, 2012 and Nov. 16, 2013, for research & development (R&D) purposes and as part of routine non-invasive prenatal testing (NIPT) laboratory procedure. One blood sample came from a woman pregnant with triplets, the remaining 35 samples came from twin pregnancies. From each pregnant woman carrying a multiple pregnancy two samples each with 7-10 ml venous blood were collected using Streck cell-free DNA blood collection tubes (Streck). The blood samples were shipped to the diagnostic laboratory with a maximum delivery time of 4 days. Other blood samples from pregnant females analysed herein were similarly collected.

Plasma preparation was performed by centrifugation (1600 g for 10 min at 4° C.) and plasma separation followed by a second centrifugation step (16000 g for 10 min at 4° C.). Extraction of total cell-free DNA (cfDNA) was performed with QIAamp Circulating Nucleic Acid Kit (Qiagen) according to the manufacturer protocol using 3.0-4.0 ml plasma with a final elution volume of 60 ul AVE-buffer (Qiagen).

DNA Quantification:

Foetal cell-free DNA (foetal cfDNA) was detected and quantified in relation to total cell-free DNA (total cfDNA) in order to determine the foetal cfDNA fraction as both a relative concentration and absolute amount using a method of the present invention. From the eluted cell-free DNA, 11 ul were digested with the CpG-methylation sensitive enzymes HhaI (0.4 U/ul), HpaII (0.3 U/ul) and BstUI (0.3 U/ul) in a 22 ul reaction using CutSmart™ Buffer (New England Biolabs). The reaction was incubated for 60 min at 37° C. and 60 min at 60° C. 10 ul from the digestion reaction was used as template DNA for quantitative probe-based PCR (reactions were conducted in duplicate), described briefly as follows.

A 25 ul PCR reaction using a 2-fold concentrated PCR master mix (QuantiFast Multiplex PCR Kit, Qiagen) was conducted. Primers that span CpG methylation sensitive restriction enzyme sites of the respective region that is differentially methylated between foetal and maternal DNA (as a DMR) were used in combination with FAM-labelled probes for such DMRs, and primers that do not span any restriction enzyme sites, an other region that is not differentially methylated between foetal and maternal DNA (as an OR) are used in combination with VIC-labelled probes for such ORs. The sequences of the primers and labelled probes used in this example are described in TABLE 1, and the thermocycler profiles used for the quantitative probe-based (TaqMan) PCR (LightCycler 480 II Instrument; Roche) are described in TABLE 2. In this example, the probes used to detect the presence of the two DMRs, are each labelled with the same detectable fluorescein amidite (FAM) fluorescent moiety, and each with the same minor binding grove (MGB) non-fluorescent quencher (NFQ) moiety, and the probes used to detect the presence of the two ORs, are each labelled with the same detectable VIC (life Technologies) fluorescent moiety, and each with the same MGBNFQ moiety.

TABLE 1

Quantitative (probe-based) PCR components

| Region | Component | Sequence (5'-3')** | SEQ ID No.* | Stock Conc | ul for 1x | Final uM Conc |
|---|---|---|---|---|---|---|
| | Master-mix | N/A | | 2x | 12.5 | 1x |
| RASSF1A DMR | DMR1-For | ATT GAG CTG CGG GAG CTG GC | 1 | 100 uM | 0.35 | 1.4 |
| | DMR1-Rev | TGC CGT GTG GGG TTG CAC | 2 | 100 uM | 0.35 | 1.4 |
| | DMR1-Probe | [FAM]-ACC CGG CTG GAG CGT-[MGBNFQ] | 3 | 100 uM | 0.035 | 0.14 |
| RASSF1A Other region | OR1-For | GGT CAT CCA CCA CCA AGA AC | 4 | 100 uM | 0.35 | 1.4 |
| | OR1-Rev | TGC CCA AGG ATG CTG TCA AG | 5 | 100 uM | 0.35 | 1.4 |
| | OR1-Probe | [VIC]-GGG CCT CAA TGA CTT CAC GT-[MGBNFQ] | 6 | 100 uM | 0.035 | 0.14 |
| TBX3 DMR | DMR2-For | GGT GCG AAC TCC TCT TTG TC | 7 | 100 uM | 0.35 | 1.4 |
| | DMR2-Rev | TTA ATC ACC CAG CGC ATG GC | 8 | 100 uM | 0.35 | 1.4 |
| | DMR2-Probe | [FAM]-CCC TCC CGG TGG GTG ATA AA-[MGBNFQ] | 9 | 100 uM | 0.035 | 0.14 |
| TBX3 Other region | OR2-For | TGT TCA CTG GAG GAC TCA TC | 10 | 100 uM | 0.35 | 1.4 |
| | OR2-Rev | CAG TCC ATG AGG GTG TTT G | 11 | 100 uM | 0.35 | 1.4 |
| | OR2-Probe | [VIC]-GAG GTC CCA TTC TCC TTT-[MGBNFQ] | 12 | 100 uM | 0.035 | 0.14 |

TABLE 1-continued

Quantitative (probe-based) PCR components

| Region | Component | Sequence (5'-3')** | SEQ ID No.* | Stock Conc | ul for 1x | Final uM Conc |
|---|---|---|---|---|---|---|
| General reagents | DMSO | N/A | | 100% | 0.025 | 0.625 |
| | MgCl2 | N/A | | 50 mM | 2 | 1 |
| | DNA sample | N/A | | | | 10 |
| | Water | | | | | — |
| | Total | | | | | 25 |

*Only nucleotide sequence listed, without dyes/quenchers
**The dyes/quenchers used for each probe are shown in "[]" parentheses

TABLE 2

Thermocycler profiles

| Step | Temperature | Time | Cycles | Analysis mode |
|---|---|---|---|---|
| Pre-incubation | 95° C. | 5 min | 1 | None |
| Denaturation | 95° C. | 10 sec | 45 | Quantification |
| Annealing | 60° C. | 10 sec | | None |
| Elongation | 72° C. | 8 sec | | Single |
| Cooling | 40° C. | | | None |

The assay design used in this example is based on two marker DMRs which are described to be hypomethylated in maternal DNA and hypermethylated in foetal DNA (Nygren, et al, 2010: Clin Chem 56, 1627; Chan et al, 2006: Clin Chem 42, 2211; Chiu et al, 2007: Am J Pathol 170, 941), and two other regions (ORs) not differentially methylated between maternal and foetal DNA which are each located between about 20 bp and 20 kb of their DMR. In particular, the methylation insensitive locus located in RASSF1A is located between 8 kb and 9 kb (8.97 kb) downstream of the methylation sensitive locus located in RASSF1A, and the methylation insensitive locus located in TBX3 is located between 10 kb and 11 kp (10.64 kb) downstream of the methylation sensitive locus located in TBX3. FIG. 2 depicts the respective arrangements and detection modalities of the two DMRs and the two other regions used in this example.

Parallel probe-based quantitative PCR reactions were performed (in separate reactions within the same PCR run) using for template a serial dilution of male genomic DNA (Promega) having known concentrations as a standard. The foetal cfDNA fraction was calculated by relative quantification of signals in the FAM channel (DMR; ie detecting foetal cfDNA) versus the VIC channel (ORs; ie detecting total cfDNA), and the absolute total cfDNA amount was calculated by absolute quantification of signals in the VIC channel obtained from the sample compared to the VIC channel obtained from the dilution series of standard DNA of known concentration. Such relative and absolute quantifications were conducted using LightCycler 480 Software release 1.5.0 (Roche).

Maternal Plasma DNA Sequencing and Data Analysis to Identify Foetal Aneuploidy:

DNA sequencing libraries were prepared using NEBNext Ultra™ DNA Library Prep Kit from Illumina. Libraries were prepared according to the manufacturer protocol automated on a Hamilton STARplus robot. Library quality and quantity was measured using a Bioanalyzer instrument (Agilent) and a Qbit Fluorometer (Invitrogen). Based on the library quantification dilutions and equimolar pools of 12 samples per pool were prepared. The pooled samples were sequenced on one lane of an Illumina v3 flow cell on an Illumina HiSeq2000 sequencer. Clonal clusters were generated using TruSeq SR Cluster Kit v3-cBot-HS on a cBot Cluster generation System according to the manufacturer protocol. Bioinformatic analysis to identify foetal chromosomal aneuploidy was carried out as described previously, with z-scores ≥3 indicating the presence of a foetal trisomy 21 (Stumm et al 2014, Prenat Diag 34:185). In cases of a positive test result for foetal aneuploidy from this method, the result was confirmed by invasive diagnostic methods.

Results:

Characteristics, % foetal fraction of cfDNA and aneuploidy test results for the blood samples are given in TABLE 3. There were two positive test results indicating foetal trisomy 21. Both were confirmed by karyotyping after amniocentesis; thus, the false positive rate in this study was 0%. One blood sample represented monochorionic twins with concordant karyotypes [47,XY,+21] and the other one represented dichorionic twins with discordant karyotypes [47,XY,+21 and 46,XX]. In both samples the foetal fraction was as high as 18.0 and 24.8%, respectively. All other NIPT results were negative for trisomies 21, 18 and 13. There is no evidence for false-negative NIPT results so far in the pregnancies included in this study. Nevertheless, a number of pregnancies are still on-going (with the last birth of the patients expected in mid May 2014) and therefore, the final detection rate is still uncertain.

TABLE 3

Characteristics and NIPT results for the collected blood samples

| Sample | Chr13 z-score | Chr18 z-score | Chr21 z-score | Foetal DNA fraction (%) | Gestational age (p.m.) | No. of foetuses, chorinicity amnionicity | NIPT result |
|---|---|---|---|---|---|---|---|
| LCMPC05 | 1.3 | −1.0 | −0.8 | 16.7 | 11 + 5 | 3, trichorionic, triamniotic | negative |
| LCMPC06 | −0.4 | 1.1 | 8.5 | 18.0 | 13 + 2 | 2, monochorionic, n.a. | T21 positive |
| LCMPC07 | −1.0 | 0.3 | 0.9 | 7.9 | 19 + 0 | 2, dichorionic, diamniotic | negative |

TABLE 3-continued

Characteristics and NIPT results for the collected blood samples

| Sample | Chr13 z-score | Chr18 z-score | Chr21 z-score | Foetal DNA fraction (%) | Gestational age (p.m.) | No. of foetuses, chorinicity amnionicity | NIPT result |
|---|---|---|---|---|---|---|---|
| LCMPC08 | 0.7 | 1.2 | 0.0 | 16.5 | 18 + 1 | 2, dichorionic, diamniotic | negative |
| LCMPC09 | 0.6 | −0.8 | 0.7 | 8.9 | 11 + 5 | 2, monochorionic, diamniotic | negative |
| LCMPC10 | 0.3 | 0.7 | −0.7 | 17.6 | 20 + 4 | 2, dichorionic, diamniotic | negative |
| LCMPC11 | −0.9 | −0.8 | 0.7 | 11.5 | 23 + 0 | 2, dichorionic, diamniotic | negative |
| LCMPC12 | −0.9 | −0.7 | −2.0 | 13.3 | 11 + 1 | 2, monochorionic, diamniotic | negative |
| LCMPC13 | 1.3 | 0.1 | 0.3 | 21.4 | 16 + 0 | 2, dichorionic, diamniotic | negative |
| LCMPC14 | 0.2 | −0.3 | 0.0 | 6.8 | 12 + 5 | 2, n.a., n.a. | negative |
| LCMPC15 | 2.2 | 0.1 | 14.7 | 24.8 | 16 + 0 | 2, dichorionic, diamniotic | T21 positive |
| LCMPC16 | 1.1 | 1.7 | 0.5 | 5.4 | 12 + 5 | 2, n.a., n.a. | negative |
| LCMPC17 | 0.7 | 1.4 | 0.5 | 16.5 | 14 + 2 | 2, n.a., n.a. | negative |
| LCMPC18 | 0.3 | 2.6 | 0.0 | 18.5 | 18 + 3 | 2, n.a., n.a. | negative |
| LCMPC19 | −0.2 | 0.8 | 0.3 | 16.6 | 14 + 0 | 2, dichorionic, diamniotic | negative |
| LCMPC20 | −0.7 | −0.9 | 0.1 | 13.1 | 15 + 4 | 2, dichorionic, diamniotic | negative |
| LCMPC21 | 1.0 | −0.7 | 1.2 | 8.4 | 9 + 3 | 2, dichorionic, diamniotic | negative |
| LCMPC22 | −1.1 | −0.2 | 0.3 | 5.6 | 16 + 2 | 2, monochorionic, n.a. | negative |
| LCMPC23 | −2.2 | 2.2 | −0.8 | 20.6 | 19 + 5 | 2, monochorionic, n.a. | negative |
| LCMPC24 | −1.6 | −0.4 | −0.5 | 14.7 | 22 + 2 | 2, monochorionic, diamniotic | negative |
| LCMPC25 | −0.8 | −0.2 | −1.5 | 12.1 | 11 + 5 | 2, n.a., n.a. | negative |
| LCMPC26 | −0.4 | −0.6 | −1.3 | 7.5 | 13 + 0 | 2, dichorionic, diamniotic | negative |
| LCMPC27 | 0.5 | −0.8 | −0.4 | 16.3 | 12 + 6 | 2, n.a., n.a. | negative |
| LCMPC28 | −1.2 | −0.3 | −0.7 | 19.4 | 10 + 1 | 2, dichorionic, diamniotic | negative |
| LCMPC29 | −0.8 | 0.7 | −0.4 | 14.2 | 13 + 2 | 2, monochorionic, n.a. | negative |
| LCMPC30 | 0.7 | 0.3 | 0.9 | 14.9 | 12 + 2 | 2, monochorionic, monoamniotic | negative |
| LCMPC31 | −0.2 | 0.3 | −0.9 | 19.3 | 19 + 1 | 2, dichorionic, diamniotic | negative |
| LCMPC32 | −1.1 | 2.5 | −2.2 | 11.6 | 20 + 0 | 2, dichorionic, diamniotic | negative |
| LCMPC33 | 0.2 | 2.2 | −1.6 | 8.6 | 11 + 0 | 2, dichorionic, diamniotic | negative |
| LCMPC34 | −1.0 | 1.2 | 0.0 | 15.1 | 15 + 4 | 2, dichorionic, diamniotic | negative |
| LCMPC35 | −0.3 | −0.8 | −0.3 | 19.2 | 12 + 0 | 2, dichorionic, diamniotic | negative |
| LCMPC36 | −1.4 | −0.5 | −0.8 | 13.9 | 12 + 0 | 2, dichorionic, diamniotic | negative |
| LCMPC37 | 1.8 | −0.7 | 0.1 | 13.8 | 17 + 6 | 2, dichorionic, diamniotic | negative |
| LCMPC38 | −0.1 | 1.1 | −0.7 | 13.4 | 13 + 1 | 2, dichorionic, diamniotic | negative |
| LCMPC39 | −1.9 | 0.2 | −2.2 | 15.0 | 17 + 0 | 2, dichorionic, diamniotic | negative |
| LCMPC40 | 0.6 | −0.4 | 0.8 | 16.2 | 18 + 3 | 2, dichorionic, diamniotic | negative |

Figure 3:
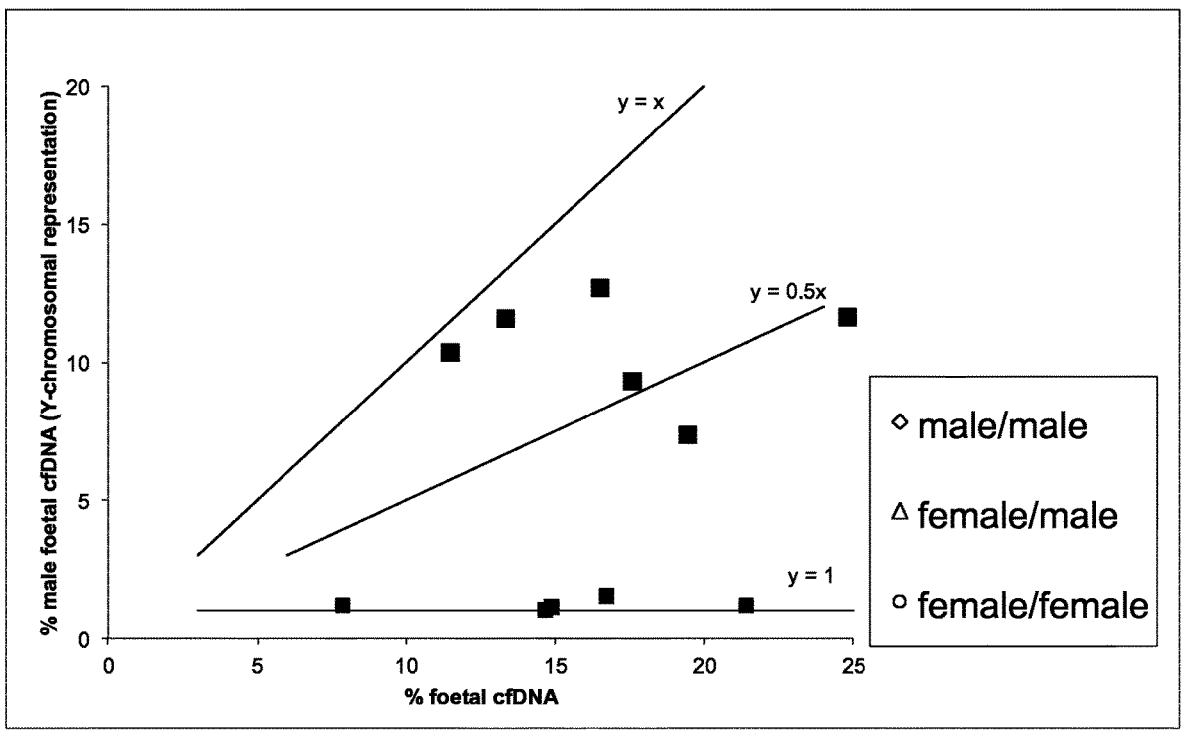
FIG. 3 depicts the correlation of the amount of male specific DNA (Y chromosomal-representation) to the foetal cfDNA fraction measured by a method of the present invention (Example 1) for study twin cases with known foetal genders.

The reliable detection of foetal aneuploidy in twin pregnancies by NIPT is dependent on a sufficiently high amount of foetal cfDNA from each foetus in the maternal blood. Different data and considerations have been published on how the lower limit of foetal cfDNA fraction should be defined to ensure that each twin's contribution is above the detection threshold (Leung et al 2013, Prenat Diag 33:675; Qu et al 2007, Am J Pathol 170:941; Struble et al 2013, Fetal Diagn Ther December 7 Epub ahead of print). This is especially important for dichorionic twin pregnancies with discordant karyotypes. In the study described above, supporting information was used for the definition of the minimum foetal cfDNA fraction for twin pregnancies derived from the Y-chromosomal representation, if only one of the two foetuses is male. Using the method of the present invention, the total foetal cfDNA fraction can be determined, which reflects the summary of foetal cfDNA derived from both foetuses. Using the Y-chromosomal representation from the next generation sequencing, the foetal cfDNA amount can be determined for male foetuses (as described in Stumm et al 2014). Thus, in the case of mixed foetal gender the contributing amount of each foetus can be determined by subtraction of the amount of foetal cfDNA determined by the Y-chromosomal representation from the foetal cfDNA fraction measured by method of the present invention. The foetal cfDNA fractions determined by the method of the present invention were compared with the values obtained from Y-chromosomal reads from next generation sequencing for cases with known gender (see FIG. 3). There is a correlation of the amount of male specific cfDNA (y axis) to the foetal cfDNA fraction measured by method of the present invention (x axis). Thus, for twin pregnancies with male/male gender approximately true is: [y=x], for female/male genders it is: [y=0.5x] and for female/female: [y=1]. The genders of cases with similar values are male/male and in case of differing values with low Y-chromosomal representation the genders are female/female. The intermediate cases, which show about half the percentage of foetal fraction as Y-chromosomal representation, are of mixed gender. The data presented in FIG. 3 show that it is not only possible to determine the foetal genders using NIPT results for twin pregnancies, but also that the measurement of the amount of foetal fraction of cfDNA determined by the method of the present invention is surprisingly accurate as compared to frequency counting of Y chromosome sequences. On the other hand, these data support the hypothesis that each foetus of a twin pregnancy contributes roughly about half of the total foetal cfDNA fraction. This leads to the conclusion that for twin pregnancies, twice the amount of foetal cfDNA would be required, and thus a recommended minimum foetal fraction of cfDNA for NIPT of a twin pregnancy could be considered to be 8%.

For monochorionic twin pregnancies with concordant genotypes (apart from rare exceptions, Chen et al 2013, Am J Med Genet A 161A:1817), a foetal cfDNA fraction of 4% would be enough to detect a foetal aneuploidy, just as for single pregnancies. However, for routine laboratory NIPT service one major issue speaks against the implication of such different quality criteria for mono- and dichorionic pregnancies: the determination of chorionicity is dependent on the gestational age and the practical experience of the physician performing the ultrasound examination. The chorionicity is clearly detectable in the first trimester of a multiple pregnancy, but in later stages detection becomes more difficult (Sperling et al 2001, Acta Obstet Gynecol Scand 80:287). Therefore, it is a safer strategy to generally define a minimum foetal cfDNA fraction for twin pregnancies, which is applicable for monochorionic as well as for dichorionic multiple pregnancies.

Identification of Vanishing Twins:

In two cases of NIPT aneuploidy testing in which the foetal cfDNA fraction was measured using the method of the present invention, identified a trisomy 21 (z-scores 13.5 and 3.4 respectively), but also a striking discrepancy between the total foetal cfDNA fraction measured by the method of the invention and the cf-Foetal-DNA amount measured by Y-chromosome representation were observed.

For case A, two analyses of blood samples (first and back-up samples) estimated the total foetal cfDNA fraction measured the method of the present invention was 20.7% and 24.8%, respectively, whereas the foetal cfDNA according to the Y-chromosomal representation from next generation sequencing was 9.2% and 9.3%, respectively. It was speculated, and reported to the physician, that the pregnancy may be a mixed-sex twin pregnancy, who confirmed that a deceased twin had been observed during ultrasound scan at week 10. A further blood sample taken in the third trimester of the pregnancy (38+2) turned out to be negative for trisomy 21 and the foetal cfDNA amount measured by Y-chromosomal representation correlated with the foetal amount measured by QuantYfeX (21.7% and 21.4), which matched the male gender determined by karyotyping of the living foetus. At birth a foetus papyraceus was found in the placental tissue from which a sufficient amount of cells could be isolated for cell culture and following GTG banding, a trisomy 21 positive, female karyotype was confirmed (47,XX,+21).

For case B, a slightly increased Y-chromosomal representation was monitored indicating male specific cf-Foetal-DNA of 3.0% and 2.7% respectively. As the foetal cfDNA fraction estimates measured by the method of the invention were far above that (13.4% and 10.0%) we hypothesized from this discrepancy in the foetal fraction measured, that two foetuses with discordant gender contribute to the foetal fraction and the male foetus being the one affected by trisomy 21. This suggestion was derived from the correlation of Y-chromosome specific foetal cfDNA amount of roughly 3% with the elevated z-score around the cut-off value of 3.0. Since the examination was clearly requested for a singleton pregnancy, the male specific foetal cfDNA was suspected to stem from a vanishing twin—maybe the carrier of a trisomy 21—that was either not recognized or not indicated on the consent form for NIPT. Thus, the result was reported to be indecisive for chromosome 21 and the conflicting data was reported to the responsible physician, including a notice regarding the potential vanishing twin, for further clarification via ultrasound. The responsible physician subsequently confirmed that the pregnancy had started as twin and later continued as a singleton pregnancy. The gender of the living and apparently healthy foetus was confirmed to be female and thus, the foetal cfDNA that caused the increased z-score for trisomy 21 can clearly be assigned to a deceased male foetus. The pregnancy is still on-going and further analysis of placental tissue and blood of the living foetus is not yet possible.

Figure 4:
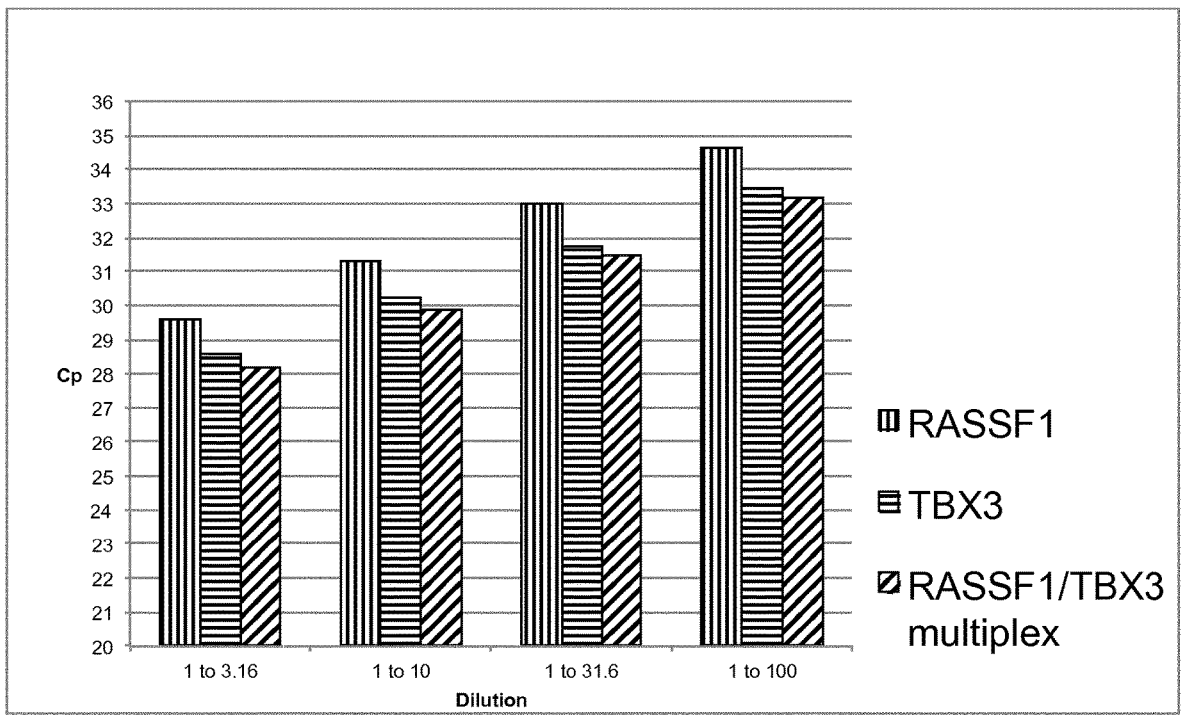
FIG. 4 depicts the improved sensitivity of a method of the invention compared to foetal cfDNA fraction detected using separate reactions of a single DMR. The number of PCR cycles (Cp) required for detection of foetal cfDNA (Example 2) in a sample using either RASSF1A or TBX3 alone as a single DMR, or as a multiplex (using the same labels) of RASSF1A and TBX3.

Example 2: Improved Detection Sensitivity Using Two Differentially Methylated Regions Using the Same Detectable Moiety/Moieties for Each Differentially Methylated Region The inventors were surprised to observe that a complex and multiplex reaction detecting two DMRs using the same detectable moiety/moieties for each of said DMR (as well as two other regions (OR) not differentially methylated) was more sensitive to detect foetal cfDNA fraction than previous detection reactions that each detected—in separate PCR reactions—a single DMR (as well as a single OR) (FIG. 4).

In a method of the present invention, two DMRs (those found in RASSF1A and TBX3, as described in Example 1) were detected (over 4 dilutions) with the same aliquot of DNA and reaction—effectively simultaneously (using quantitative probe-based (TaqMan) PCR) with two ORs (those found in RASSF1A and TBX3, as described in Example 1), using: (x) the same detectable moiety/moieties for each of said DMR; and (y) a detectable moiety/moieties for said at least one OR that is/are different to the detectable moiety/moieties used for said DMRs. In comparison, detection of foetal cfDNA fraction was less sensitive, as shown by detection at higher cycle numbers (Cp), if each DMR (and corresponding OR) was detected independently in separate reactions. The regions/markers, primers/probes and detection methodology was substantially as described in Example 1, except that for the single locus reactions, only the DMR and OR from a given gene (RASSF1A or TBX3) were detected simultaneously in a single reaction.

In contrast, detection of foetal cf DNA fraction using a multiplex reaction of the two DMRs using different detectable moieties (eg FAM for the RASSF1A locus and VIC for the TBX3 locus) is determined to be even less sensitive, and further is difficult to detect simultaneously with any OR; without being bound by theory, believed due to the higher complexity of colour compensation, the limited number of separately detectable fluorescent markers and/or the "bleaching" effects from so many fluorescent markers being present in the same reaction.

Given the exponential nature of quantitative PCR detection, a higher sensitivity of detection (ie lower cycle numbers) would also equate to higher accuracy of quantification, as the correction to standard curves, and interpolation between data points, would be subject to less error than that arising with the amounts of DNA correlating to detection at higher cycle numbers.

Example 3: Detection of an Increased Risk of a Pregnant Woman Suffering from or Developing Preeclampsia (Prophetic Example)

Using a method of the present example, pregnant women are assessed for their risk of suffering from or developing preeclampsia as follows. Firstly, a blood sample is collected from the woman for whom such risk to be assessed and total cfDNA extracted from the plasma of such sample substantially in accordance with the procedures described in Example 1. Secondly, using a method substantially as described in Example 1, a relative and/or absolute amount of foetal cfDNA and total cfDNA present in the plasma is determined, where the absolute amount of foetal and/or total cfDNA can be expressed as the amount of genome equivalents ("Eq"). Thirdly, such determined amount of cfDNA and/or total cfDNA is compared to a threshold amount or a reference distribution of amounts, and the women is determined to be at increased risk of suffering from or developing preeclampsia if the amount of foetal cfDNA or total cfDNA exceeds such threshold value and/or is an outlier in such distribution.

For example, using published threshold values (Papantoniou et al 2013, Prenat Diag 33:682) if the total cfDNA exceeds an amount of about 7,500 Eq/mL plasma or if the foetal cfDNA fraction exceeds an amount of about 500

Eg/mL plasma, then the woman is determined to have such an increased risk. Such a risk may instead or additional be assessed by considering: (i) the fold-increase (eg 1.5, 3, 3.5 or 4-fold increase) of foetal cfDNA (determined for such woman compared to a threshold amount), factoring into the determination that for later-term pregnancies a higher fold-increase in foetal cfDNA may be utilised (Zeybek et al 2013, J Obstet Gynaecol Res 39:632); and/or (ii) into which percentile the amount of cfDNA determined from the woman falls, from consideration of a reference distribution of amounts determined from low-risk women or women who did not suffer from or develop preeclampsia, for example if the foetal cfDNA fraction falls within the 90$^{th}$ percentile of such a distribution, then the woman is considered to have an increased risk of suffering mild or severe preeclampsia (Jakobsen et al 2013, Transfusion 53:1956).

In this example, t detection of a risk is conducted using a computer program product that performs the operations represented by FIG. 5. Operation (A) receives signals (1) and (2) representing, respectively, foetal and total cfDNA are used by the computer program product to determine a parameter (4) that represents the relative and/or absolute amount of foetal (or total) cfDNA present in the plasma of the woman. This operation may optional receive a signal (3) representing an absolute amount of standard DNA. A second operation (B) compares such determined parameter (4) against a threshold amount (5) and/or a reference population of amounts (6) so as to determine and report (7) whether or not—and based on such comparison—the woman is determined to be at increase risk of suffering or developing preeclampsia.

Example 4: Detection of Tumour-Associated DNA in Samples from Cancer Patients (Prophetic Example)

Methylation of RASSF1A and at least one other DMR such as ER-beta (oestrogen receptor beta), RAR-beta2 (retinoic acid receptor beta 2) and/or Cyclin D2 is used to detect cfDNA derived from a tumour and to assess the risk of women suffering from breast cancer. Specific methylation at such DMRs is a characteristic of tumour-derived cfDNA, and a method of the present invention is used to detect and to quantify the amount tumour derived cfDNA in the plasma of women, and those determined to have elevated (or outlying) amounts of tumour-derived cfDNA are determined to be at increased risk from suffering from or developing breast cancer. Essentially, the process described in Example 3 is followed except that DMR2 and OR2 are located in one of ER-beta, RAR-beta2 or Cyclin D2, rather than TBX3. Primers and probes to detect such DMR2 and OR2 for use in this embodiment of the present invention are designable by the person of ordinary skill.

In this example, a similar computer program product as described in Example 3 can be used to asses the risk for a given woman is based on the amount of tumour-derived cfDNA present in her blood, but in this example this parameter is compared against a threshold amount or distribution of amounts that is derived from a study of the amount of tumour-derived cfDNA present in control and breast-cancer patients; and those women having an elevated (or outlying) amount of tumour-derived cfDNA are considered to have an increased risk of suffering from or developing breast cancer.

Example 5: Use of a Method of the Invention in NIPT to Detect Trisomy 21

The inventors surprised to observe that a further adaptation of a method of the present invention could be used to identify cfDNA samples obtained from pregnant females that were carrying a trisomy 21 foetus.

In a single multiplex PCR reaction, the amount of a foetal chromosomal 21 DNA species present in cfDNA samples obtained from 138 pregnant human females was determined using a method of the invention, and the amount of a foetal chromosomal 12 (as a reference chromosome) DNA species present in the cfDNA sample was also determined using a method of the invention, and in respect of each pregnant female. The relative amounts of such foetal chromosomal 21 species and such foetal chromosomal 12 species was calculated as a ratio, and run-specific z-score analyses using an internal reference set of euploid samples was conducted. Those samples showing a z-score greater than about 3 were determined as "positives". The second scatter plot of FIG. 8 shows that the outlying positive samples are those obtained from the 8 pregnant females of the set of 138 known to carry a foetus with trisomy 21 ("T21"). All eight samples were successfully classified with no false negative or false positive result.

The amount of a foetal chromosomal 21 DNA species was determined by using, in a method of the present example, a DMR present in the DSCAM gene (Down Syndrome Cell Adhesion Molecule; NCBI Reference Sequence *Homo sapiens* chromosome 21, GRCh38.p2 Primary Assembly: NC_000021.9 GI:568815577, region 40010999 to 40847113; SEQ ID No.: 200) located on human chromosome 21 and an other region also located between about 300 bp and 500 bp of the DMR. The amount of a foetal chromosomal 12 DNA species was determined by using, in a method of the present example, a DMR present in the TBX3 gene (as described above) located on human chromosome 12 and an other region also located between about 10 Kb of the DMR. The sequences of the respective DMRs and ORs used are described in TABLE 7.

TABLE 7

Chromosome 21 and chromosome 12 DMRs and ORs

| Chr. | Chr. location | Gene | Type | Sequence (5'-3') | SEQ ID No. |
|---|---|---|---|---|---|
| 21 | 40841691-40841781 | DSCAM | DMR | ATTGGAAGGTCAgCCA ATCAGGCGCGGAGCTG CTCCCGG(t)AGCTGC CACCTCCGAGGCGCGC GCCACGCCGGGGTTCC cTcGCGGCTTTGGA | 201 |
| 21 | 40841286-40841372 | DSCAM | OR | TCCGTGTGCTCCACCC TTTGAATTCAGAACGA CATAGTGGATACTCCG TGGGGCTGCTGGAATC TTCCaTTCcCACTGCC TTATCTT | 202 |
| 12 | 114687093-114687191 | TBX3 | DMR | AAGGTGCGAACTCCTC TTTGTCTCTGCGTGcC CGGCGCGCCCCCCTCC CqGTGGGTGATAAAcC CACTCTGGCGCCGGcC ATGCGcTGGgTGATTA ATT | 203 |
| 12 | 114676384-114676454 | TBX3 | OR | TGTTcACTGGAGGACT CATCAGAGGTCCCATT CTCCTTTTTGTGTCTT TCATCAAACACCCTCA tGGACTG | 204 |

Methylation sensitive sites are underlined and locations of known SNPs are shown by non-capitalisation cfDNA samples from 138 pregnant human females (including 8 of which were known to carry a foetus with T21 were collected, prepared and digested with the CpG-methylation sensitive enzymes HhaI, HpaI and BstUI as described in EXAMPLE 1. A multiplex quantitative probe-based PCR reaction of the four separate loci described in TABLE 6 was conducted on replicates (n=6) of each such sample as described in EXAMPLE 1, except that the PCR buffer used was PerfeCTa MultiPlex qPCR ToughMix (Quanta BioSciences) and using the PCR primers and labelled probes (with quenchers) as set forth in TABLE 8.

TABLE 8

Primer and probes

| Chr. | Region | Component | Sequence (5'-3')** | SEQ ID No.* |
|---|---|---|---|---|
| 21 | DSCAM DMR | Chr21DMR-For | ATTGGAAGGTCAGCCAAT CAGG | 205 |
|  |  | Chr21DMR-Rev | TCCAAAGCCGCGAGGGAA C | 206 |
|  |  | Chr21DMR-Probe | [LCCyan500]-CGCCTC GGAGGTGGCAGCTC-[BHQ1] | 207 |
| 21 | DSCAM Other region | Chr21OR-For | TCCGTGTGCTCCACCCTT TG | 208 |
|  |  | Chr21OR-Rev | AAGATAAGGCAGTGGGAA TGGAAG | 209 |
|  |  | Chr21OR-Probe | [Cy5]-CCAGCAGCCCCA CGGAGTATCC-[BHQ3] | 210 |
| 12 | TBX3 DMR | Chr12DMR-For | AAGGTGCGAACTCCTCTT TGTC | 211 |
|  |  | Chr12DMR-Rev | AATTAATCACCCAGCGCA TGGC | 212 |
|  |  | Chr12DMR-Probe | [6FAM]-CCCCTCCCGGT GGGTGATAAACC-[Eclipse] | 213 |
| 12 | TBX3 Other region | Chr12OR-For | TGTTCACTGGAGGACTCA TC | 214 |
|  |  | Chr12OR-Rev | CAGTCCATGAGGGTGTTT G | 215 |
|  |  | Chr12OR-Probe | [LCRed610]-AGGTCCC ATTCTCCTTTTTGTGTCT TTC-[BBQ650] | 216 |

*Only nucleotide sequence listed, without dyes/quenchers
**The dyes/quenchers used for each probe are shown in "[]" parentheses The format of such assay is generally as depicted in FIG. 6, where the DMR1 and OR1 of such figure are located in the DSCAM gene of human chromosome 21, and the DMR1' and OR1' of such figure are located in the TBX3 gene of human chromosome 12 (in this example, each chromosome was detected with only one DMR/OR pair, and hence the optional second pairs represented by (2) and (2') in such figure are not included in the present example). As will be observed from TABLE 8, the probe for the chromosome 21 DMR is labelled differently from the probe for the chromosome 12 DMR (and each of the ORs are differently labelled). This enables the foetal fraction of cfDNA for each chromosome-specific DNA species to be separately calculated by relative quantification of the chromosome-specific DMR to the respective chromosome-specific OR, and the absolute total cfDNA amount for each chromosome was calculated by absolute quantification of signals for the respective OR from the sample compared to signals for the respective OR obtained from the dilution series of standard DNA of known concentration (as described in EXAMPLE 1) provided in each qPCR plate (run) as the test samples.

Such relative and absolute quantifications were conducted using LightCycler 480 Software release 1.5.0 (Roche). The mean [n=6 replicates] sample-specific ratio of the % foetal cfDNA chromosome 21 DNA species and the % foetal cfDNA chromosome 12 DNA species was calculated for each sample, and for each plate the overall mean and standard deviation of such ratios for the known euploid samples were calculated; from which parameters all test samples on such qPCR plate (run) were individually analysed to give a Z-score (on such on a plate-by-plate basis) for each test sample (including those test samples known to be trisomy 21). The second scatter plot in FIG. 8 displays the z-score (calculated on a plate-by-plate basis) for each test sample showing separation of all trisomy samples from the euploid samples.

Example 6: Iterative z-Score Analysis to Detect Trisomy 21 in NIPT without Reference to Known Internal Euploid Standards By the application of an iterative z-score approach, the inventors were able to identify all known Trisomy 21 samples from the test samples without reference to the known euploid samples in the estimation of mean and standard deviations in the z-score analysis.

The data from each run (qPCR plate) of samples analysed in EXAMPLE 5 was re-analysed as follows. Firstly, the mean ration of chromosome 21 to reference chromosome of each replicate of the samples (n=6) was calculated, and for all samples present in such run (plate) an overall mean and standard deviation was calculated without reference to whether a sample was known to be euploid or trisomy. The first mean ratio for each sample is shown in the first scatter plot of FIG. 8 (with the euploid and T21 samples plotted with different symbols) for all samples across all runs. Secondly, based on such run-specific means and standard deviation, a (run specific) z-score for each sample present in the run was calculated. The third scatter plot of FIG. 8 shows such masked z-scores for all samples across all runs. Thirdly, those samples showing a z-score of greater than about 1.9 were removed from the data set, a second mean and standard deviation was calculated on the data in respect of the remaining samples in the data set and used to conduct a second z-score analysis of all samples in the set. The fourth scatter plot of FIG. 8 shows the z-scores for all samples across all runs following such first iterative elimination. Fourthly, those samples showing a z-score from the first iterative elimination of greater than about 1.9 were also removed from the data set, a third mean and standard deviation was calculated on the data in respect of the remaining samples in the data set and used to conduct a third z-score analysis of all samples in the set. The fifth scatter plot of FIG. 8 shows the z-scores for all samples across all runs following such second iterative elimination and displays complete separation of the euploid and T21 samples (represented by z-scores greater than about 3.0); without reference to any of the samples a-priori known to be euploid.

In view of the above, it will be appreciated that the present invention also relates to the following items:
1. A method for detecting in a sample from an individual an amount of a species of DNA originating from cells of a given type, which sample comprises said species of DNA in admixture with differently methylated DNA not originating from cells of said type; said method comprising the steps:

(a) treating the DNA present in said sample with a reagent that differentially modifies methylated and non-methylated DNA;
(b) detecting in said sample the presence of methylation in said species of DNA at two or more differentially methylated regions (DMRs) that are differently methylated between said species of DNA and the DNA not originating from cells of said type, the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample; and
(c) detecting an amount of total DNA present in said sample using at least one other region that is not differently methylated between said species of DNA and the DNA not originating from cells of said type, the modification of which region(s) by said reagent is insensitive to methylation of DNA,
wherein, said detection in step (b) and said detection in step (c) are made using the same aliquot of DNA of said sample, and in the same vessel, and effectively simultaneously for such DMRs and other region(s), and using: (x) the same detectable labels(s) for each of said DMRs; and (y) a different detectable label(s) for said other region(s).
2. The method of item 1, wherein prior to or as part of said detection in step (b) and/or step (c), each DNA region comprising said DMRs and/or said other region(s), respectively, is(are) amplified.
3. The method of item 1 or 2, wherein each detectable label used in step (b) and/or step (c) is independently selected from the group consisting of: fluorescent, protein, small molecule or radioactive label.
4. The method of any one of items 1 to 3, wherein said detection in step (b) comprises multiplex real-time probe-based quantitative probe-based PCR using at least two labelled probes each of which specific for one of said DMRs.
5. The method of any one of items 1 to 4, wherein said detection in step (c) comprises real-time quantitative PCR using at least one labelled probe specific for one of said other region(s).
6. The method of any one of items 1 to 5, wherein said other region is located between about 20 bp and about 20 kb upstream or downstream of, and/or within the same gene as, at least one of said DMRs.
7. The method of any one of items 1 to 6, wherein said detection in step (c) comprises using at least two of said other regions; preferably wherein, the number of said other regions is the same as the number of DMRs used in step (b); more preferably wherein, one of said other regions is located between about 20 bp and about 20 kb upstream or downstream of a DMR used in step (b) and each other of the said other regions is located between about 20 bp and about 20 kb upstream or downstream of another of said DMRs.
8. The method of item 7, wherein said detection in step (c) is made using: (x) the same detectable label(s) for each of said other regions or (y) a different detectable label(s) for each of said other regions.
9. The method of item 7 or 8, wherein said detection in step (c) comprises multiplex real-time quantitative probe-based PCR using at least two labelled probes each of which is specific for one of said other regions.
10. The method of any one of items 1 to 9, wherein said detection in step (c) and said detection in step (b) are made using the same aliquot of DNA of said sample, and in the same reaction/detection vessel, and effectively simultaneously with each other, and by multiplex real-time quantitative probe-based PCR using at least one labelled probe specific for each of the said DMRs and other region(s).
11. The method any one of items 1 to 10, wherein said species of DNA originates from cells of a foetus and/or the placenta of a foetus and said sample is from a pregnant female; preferably wherein, said species of DNA is circulating cell-free DNA and said sample is a blood fraction such as plasma or serum.
12. The method of item 11, wherein said DMRs comprises at least one, preferably at least two, methylation site(s) specific for said reagent, and at least one of said DMRs is located in a portion of the genome and/or gene selected from the group consisting of: RASSF1A, TBX3, HLCS, ZFY, CDC42EP1, MGC15523, SOX14 and SPN; preferably wherein,
each of said DMRs is located in a portion of the genome and/or gene selected from the group consisting of: RASSF1A, TBX3, HLCS, ZFY, CDC42EP1, MGC15523, SOX14 and SPN; and/or
at least one of said DMRs is located between about positions 4,700 bp and 5,600 bp of RASSF1A or about positions 1,660 bp and 2,400 bp of TBX3; more preferably wherein,
said two or more DMRs comprise those located between about positions 4,700 bp and 5,600 bp of RASSF1A and about positions 1,660 bp and 2,400 bp of TBX3.
13. The method of item 11 or 12, wherein said other region is located in a portion of the genome and/or gene selected from the group consisting of: GAPDH, beta-actin, ALB, APOE, RNASEP, RASSF1A, TBX3, HLCS, ZFY, CDC42EP1, MGC15523, SOX14 and SPN; preferably wherein,
said other region comprises a region without a methylation site specific for said reagent and said locus is located in the genes RASSF1A or TBX3, more preferably wherein,
two or more of said other regions are used in detection step (c) and comprise those located between about positions 14,220 bp and 13,350 bp of RASSF1A and about positions 12,400 bp and 13,000 bp of TBX3.
14. The method any one of items 11 to 13, wherein said pregnant female is susceptible to a pregnancy-associated medical condition; preferably wherein, said pregnancy-associated medical condition is selected from the group consisting of: preeclampsia, preterm labour, intrauterine growth retardation and vanishing twin.
15. The method of any one of items 1 to 10, wherein said species of DNA originates from a cell type associated with a medical condition; preferably wherein, said medical condition is one selected from the group consisting of: a cell proliferative disorder, an infection/infectious disease, a wasting disorder, a degenerative disorder, an (auto)immune disorder, kidney disease, liver disease, inflammatory disease acute toxicity, chronic toxicity, myocardial infarction, and a combination of any of the forgoing; more preferably wherein, said species of DNA is circulating cell-free DNA and said sample is a blood fraction such as plasma or serum.
16. The method of item 15, wherein said species of DNA originates from cells of a tumour; preferably wherein, said tumour is a carcinoma or cancer of an organ selected from the group consisting of: liver, lung, breast, colon, oesophagus, prostate, ovary, cervix, uterus, testis, brain, bone marrow and blood.

17. The method of item 16, wherein said DMRs comprises at least one, preferably at least two, methylation site(s) specific for said reagent, and at least one of said DMR is located in a portion of the genome and/or a gene selected from the group consisting of: a tumour suppressor gene, p16, SEPT9, RASSF1A, GSTP1. DAPK, ESR1, APC, HSD17B4 and H1C1; preferably wherein, one of said two or more DMRs is located in RASSF1A; more preferably wherein, one of said two or more DMRs is located between about positions 4,700 bp and 5,600 bp of RASSF1A; and/or more preferably wherein, said other region is located between about positions 14,220 bp and 13,350 bp of RASSF1A.

18. The method of any one of items 1 to 17, wherein said sample is a tissue sample or a sample of biological fluid; preferably wherein, said sample is a sample of biological fluid selected from the group consisting of: whole blood, a blood fraction, urine, saliva, sweat, ejaculate, tears, phlegm, vaginal secretion, vaginal wash and colonic wash; more preferably wherein, said sample is a plasma or serum sample.

19. The method of any one of items 1 to 18, wherein said reagent that differentially modifies methylated and non-methylated DNA comprises bisulphite.

20. The method of any one of items 1 to 18, wherein said reagent that differentially modifies methylated and non-methylated DNA comprises an agent that selectively digests unmethylated over methylated DNA, preferably wherein, said agent comprises:
 at least one methylation sensitive enzyme;
 at least one methylation sensitive restriction enzyme; and/or
 an agent selected from the group consisting of: AatII, AciI, AclI, AfeI, AgeI, AgeI-HF, AscI, AsiSI, AvaI, BceAI, BmgBI, BsaAI, BsaHI, BsiEI. BsiWI, BsmBI, BspDI, BsrFI, BssHII, BstBI, BstUI, ClaI, EagI, FauI, FseI, FspI, HaeII, HgaI, HhaI, HinP1I, HpaII, Hpy99I, HpyCH4IV, KasI, MluI, NaeI, NarI, NgoMIV, NotI, NotI-HF, NruI, Nt.BsmAI, Nt.CviPII, PaeR7I, PluTI, PmlI, PvuI, PvuI-HF, RsrII, SacII, SalI, SalI-HF, SfoI, SgrAI, SmaI, SnaBI, TspMI and ZraI.

21. The method of any one of items 1 to 20, wherein each of said detection steps comprises quantitative detection and said detected amount of said species of DNA is expressed as a relative concentration of said species of DNA to the total DNA in said sample.

22. The method of any one of items 1 to 20, further comprising the steps:
 detecting an amount of total DNA in a standard sample of DNA of known amount using the same other regions(s) as used in step (c); and
 comparing the signal detected from said standard sample of DNA to the signal detected in step (c).

23. The method of item 22, wherein each of said detection steps comprises quantitative detection and said detected amount of said species of DNA is expressed as an absolute amount of said species of DNA in said sample.

24. The method of item 21 or 23, further comprising the step:
 comparing the amount of said species of DNA detected with a threshold amount and/or reference distribution of amounts, wherein: (x) an increase in, or outlying of, the amount of said species of DNA indicates an increased risk of the individual suffering from or developing a medical condition; and/or (y) an amount of said species of DNA in excess to said threshold, or outlying from said distribution, indicates that a diagnosis for an abnormality in the said species of DNA present in said sample may be performed on, preferably a separate aliquot of DNA of, said sample.

25. The method of any one of items 21 to 24, further comprising the step:
 performing on, preferably with a separate aliquot of DNA of, said sample, a diagnosis for an abnormality in said species of DNA present in said sample; preferably wherein, said species of DNA originates from cells of a foetus and/or the placenta of a foetus, said sample is from a pregnant female and said diagnosis is a prenatal diagnosis.

26. The method of item 25, wherein said diagnosis comprises a step that uses a detection technology selected from the group consisting of: DNA sequencing, SNP analysis, digital PCR and hybridisation; preferably wherein, said detection technology is massively parallel sequencing of DNA; more preferably wherein said detection technology is massively parallel sequencing of random and/or enriched DNA.

27. The method of item 25 or 26, wherein:
 (x) said species of DNA originates from cells of a foetus and/or the placenta of a foetus, said sample is from a pregnant female and said abnormality is a genetic mutation or a chromosomal abnormality, such as a chromosomal trisomy, associated with a foetal abnormality and/or a congenital disorder; preferably wherein:
  said genetic mutation is selected from the group consisting of: colour blindness, cystic fibrosis, hemochromatosis, haemophilia, phenylketonuria, polycystic kidney disease, sickle-cell and disease, Tay-Sachs disease; and/or
  said chromosomal abnormality is selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis; or
 (y) said species of DNA originates from cells of a tumour and said abnormality is a genetic mutation or a chromosomal abnormality associated with the diagnosis, prognosis or predictive treatment of a carcinoma or cancer; preferably wherein:
  said genetic mutation is selected from the group consisting of: a mutation in a tumour suppressor gene (such as TP53 (p53), BRCA1, BRCA2, APC or RB1), a mutation in a proto-oncogene (such as RAS, WNT, MYC, ERK, or TRK) and a DNA repair gene (such as HMGA1, HMGA2, MGMT or PMS2); and/or
  said chromosomal abnormality is a translocation (such as t(9;22)(q34;q11) [ie, Philadelphia chromosome or BCL-ABL], t(8;14)(q24;q32), t(11;14)(q13;q32), t(14;18)(q32;q21), t(10;(various))(q11;(various)), t(2;3)(q13;p25), t(8;21)(q22;q22), t(15;17)(q22;q21), t(12;15)(p13;q25), t(9;12)(p24;p13), t(12;21)(p12;q22), t(11;18)(q21;q21), t(2;5)(p23;q35), t(11;

22)(q24;q11.2-12), t(17;22), t(1;12)(q21;p13), t(X;18)(p11.2;q11.2), t(1;19)(q10;p10), t(7,16)(q32-34;p11), t(11,16)(p11;p11), t(8,22)(q24;q11) or t(2;8)(p11;q24)).

28. The method of item 11, wherein said DMR(s) is/are hypermethylated in foetal DNA and hypo methylated in maternal DNA.

29. The method item 28, wherein said DMR(s) comprises at least one, preferably at least two, methylation site(s) specific for said reagent, and at least one of said DMR(s) is located in a region and/or gene selected from the list(s) consisting of one disclosed in WO 2011/034631 as being hypermethlyated in foetal DNA relative to maternal DNA, including SEQ ID NOs 1-59, 90-163, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and/or 261 of WO 2011/034631.

30. The method of item 29, wherein at least one of said DMR(s) is located in a region and/or gene selected from the list consisting of: SEQ ID NOs 1-39, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and/or 261 of WO 2011/034631, preferably selected from the list consisting of: SEQ ID No NOs 33-39, 176, 179, 180, 184, 188, 189, 190, 191, 193, 195, 198, 199, 200, 201, 202, 203, 205, 206, 207, 208, 209, 210, 211, 212, 213, 214, 221, 223, 225, 226, 231, 232, 233, 235, 239, 241, 257, 258, 259, and/or 261 of WO 2011/034631.

31. The method item 11 or 28, wherein said DMR(s) comprises at least one, preferably at least two, methylation site(s) specific for said reagent, and at least one of said DMR(s) is located in a region and/or gene disclosed in WO 2011/092592, including on selected from the list(s) consisting of: EP1, EP2, EP3, EP4, EP5, EP6, EP7, EP8, EP9, EP10, EP11 and EP12 [SEQ ID NOs 33-44] of WO 2011/092592.

32. The method of item 11 or 28, wherein said DMR(s) comprises at least one, preferably at least two, methylation site(s) specific for said reagent, and at least one of said DMR(s) is located in a region and/or gene selected from the list consisting of: AIRE, SIM2, ERG and VAPA-APCDDI, or is HLCS.

33. The method of any one of items 11 or 28 to 32, wherein at least one of said DMR(s):
is located on a human chromosome selected from the list consisting of: chromosome 21, chromosome 18, chromosome 13, X-chromosome and Y-chromosome, preferably chromosome 21, chromosome 18, chromosome 13, most preferably chromosome 21; and/or
comprises at least one, preferably at least two, methylation site(s) specific for said reagent, and said DMR is located in a regions and/or gene selected from the list consisting of: maspin [preferably a portion of the maspin (aka "SERPINB5") gene that described in EP 1 751 307 as being differentially methylated between a foetus and its mother], CGI137, PDE9A, PPP1R2P2, Similarity to Fem1A (*C. elegans*), CGI009, CBR1, DSCAM, C21orf29 and CGI13.

34. The method of item 11 or 28, wherein at least one of said DMR(s) is located in a region and/or gene selected from the list consisting of: RASSF1A, TBX3, ZFY, CDC42EP1, MGC15523, SOX14 and SPN.

35. The method of item 11 or 28, wherein at least one of said DMR(s) is located in a region and/or gene selected from the list consisting of: SEQ ID NOs: 40-59 and 90-163 of WO 2011/034631.

36. The method of any one of items 11, 28, 29, 34 or 35, wherein at least one of said DMR(s):
is located on a human chromosome selected from the list consisting of: chromosome 1 to 12, chromosome 14 to 17, chromosome 19, chromosome 20 chromosome 22 and chromosome 23; and/or
comprises at least one, preferably at least two, methylation site(s) specific for said reagent, and said DMR is located in a regions and/or gene selected from the list consisting of: CD48, FAIM3, ARHGAP25, SELPLG, APC, CASP8, RARB, SCGB3A1, DAB2IP, PTPN6, THY1, TMEFF2 and PYCARD.

37. The method of any of items 1 to 36, wherein a plurality of species of DNA are detected in said sample; preferably wherein, two species of DNA are detected in said sample.

38. The method of item 37, wherein:
in at least one detection step (b):
the presence of methylated DNA at a first set of two or more DMRs is used to indicate the presence of an amount of a first species of DNA in said sample and the absence of methylated DNA at said first set of DMRs indicates the absence of said first species of DNA in said sample; preferably wherein, said first species of DNA originates from cells of a foetus and/or the placenta of a foetus, said sample is from a pregnant female and at least one of said first set of DMRs is one set forth in any one of items 30 to 33; and
the presence of methylated DNA at a second set of two or more DMRs is used to indicate the presence of an amount of a second species of DNA in said sample and the absence of methylated DNA at said second set of DMRs indicates the absence of said second species of DNA in said sample; preferably wherein, said second species of DNA originates from cells of a foetus and/or the placenta of a foetus, said sample is from a pregnant female and at least one of said second set of DMRs is one set forth any one of items 34 to 36; and
in at least one detection step (c):
a first amount of total DNA present in said sample is detected using a first region that is not differently methylated between said first species of DNA and the DNA not originating from cells of said type, the modification of which first other region by said reagent is insensitive to methylation of DNA, wherein said first other region is located between about 20 bp and about 20 kb upstream or downstream of at least one of said first set of DMRs; and
a second amount of total DNA present in said sample is detected using a second region that is not differently methylated between said second species of DNA and the DNA not originating from cells of said type, the modification of which second other region by said reagent is insensitive to methylation of DNA, wherein said second other region is located between about 20 bp and about 20 kb upstream or downstream of at least one of said second set of DMRs.

39. The method of item 38, wherein said detection in step (b) of said first and second set of DMRs and said detection in step (c) of said first and second other regions are made using the same aliquot of DNA of said sample, and in the same reaction/detection vessel, and effectively simultaneously for such DMRs and other regions, and using: (x) a different detectable label(s) for each of said first and second set of DMRs DMRs; and (y) further different detectable label(s) for each of said first and second other regions.

40. The method of item 39, wherein said detection in step (c) and said detection in step (b) are made by multiplex real-time quantitative probe-based PCR using at least one labelled probe specific for each of said DMRs and other regions.

41. The method of any one of items 37 to 40, wherein said agent comprises at least one methylation sensitive restriction enzyme.

42. The method of any one of items 38 to 41, wherein each of said detection steps comprises quantitative detection and said detected amount of each of said species of DNA is expressed as a relative concentration of said species of DNA to the respective amount total DNA detected in said sample from the respective other region.

43. The method of any one of items 38 to 41, further comprising the steps:
    detecting an amount of total DNA in a standard sample of DNA of known amount using the same other regions as used in step (c); and
    comparing the signal detected from said standard sample of DNA to the respective signal detected in step (c) for each of the other regions.

44. The method of item 43, wherein each of said detection steps comprises quantitative detection and said detected amount of said species of DNA is expressed as an absolute amount of each or said species of DNA in said sample.

45. The method of item 42 or 44, further comprising the step:
    determining the relative amount, preferably a ratio, of: (x) said first species of DNA detected with the first set of two or more DMRs; and (y) said second species of DNA detected with the second set of two or more DMRs; and
    comparing said relative amount or ratio with a threshold and/or reference distribution of amount(s) or ratio(s), wherein: a relative amount or ratio that is higher or lower than said threshold and/or reference distribution of amount(s) or ratio(s) indicates the presence of an abnormality in said first and/or second species of DNA present in said sample; preferably wherein, said abnormality is a chromosomal abnormality; more preferably wherein, said chromosomal abnormality is associated with a foetal abnormality and/or congenital disorder; yet more preferably wherein, said chromosomal abnormality is selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis; most preferable wherein, said chromosomal abnormality is a trisomy, such as one selected from the list consisting of trisomy 21, trisomy 18, or trisomy 13.

46. A method for detecting a chromosomal aneuploidy in a foetus carried by a pregnant female, said method comprising the steps:
    (A) Determining, using a method as set forth in any one of the items above, in a sample taken from said pregnant female the amount of a first species of DNA that originates from cells of a foetus and/or the placenta of a foetus, wherein said first species of DNA is located on a chromosome relevant to the chromosomal aneuploidy or within a section of a chromosome relevant to the chromosomal aneuploidy, and wherein said first species of DNA that originates from cells of a foetus and/or the placenta of a foetus is distinguished from its counterpart of maternal origin in the sample due to differential DNA methylation;
    (B) Determining, using a method as set forth in any one of the items above, the amount of a second species of DNA that originates from cells of a foetus and/or the placenta of a foetus in said sample, wherein said second species of DNA is located on a reference chromosome, and wherein said second species of DNA that originates from cells of a foetus and/or the placenta of a foetus is distinguished from its counterpart of maternal origin in the sample due to differential DNA methylation;
    (C) determining the relative amount, preferable the ratio, of the amounts from (A) and (B); and
    (D) comparing said relative amount or ratio with a threshold and/or reference distribution of amount(s) or ratio(s), wherein: a relative amount or ratio that is higher or lower than said threshold and/or reference distribution of amount(s) or ratio(s) indicates the presence of the chromosomal aneuploidy in the foetus.

47. A method for detecting an increased risk of an individual suffering from or developing a medical condition; said method comprising the steps:
    (i) conducting the method of item 21 or 23; and
    (ii) comparing the amount of said species of DNA detected with a threshold amount and/or a reference distribution of amounts,
    wherein an increase in, or outlying of, the amount of said species of DNA indicates an increased risk of the individual suffering from or developing said medical condition.

48. A composition comprising:
    two pairs of PCR primers, each pair for amplifying one of said two of more DMRs as set forth in any of items 1 to 47;
    one pair of PCR primers for amplifying said other region as set forth in any of items 1 to 47;
    two labelled probes as set forth in item 4; and
    one labelled probe as set forth in item 5.

49. The composition of item 48, further comprising:
    a further pair of PCR primers for amplifying a second other region as set forth in any of items 9 to 47; and
    a further labelled probe as set forth in item 9.

50. A kit comprising:
    the primers and probes as set forth in item 48 or 49; and
    optionally, further comprising: (i) a printed manual or computer readable memory comprising instructions to use said primers and probes to practice a method of any one of items 1 to 47 and/or to produce or use the composition of item 48 or 49; and/or (ii) one or more other item, component or reagent useful for the practice of a method of any one of items 1 to 47 and/or the production or use of the composition of item 48 or 49, including any such item, component or reagent disclosed herein, such as the reagent that differently modifies methylated and non-methylated DNA as set forth in any one of items 1 to 47.

51. A computer program product comprising a computer readable medium encoded with a plurality of instructions for controlling a computing system to perform and/or manage an operation for determining: (x) an increased risk of an individual suffering from or developing a medical condition and/or (y) if a diagnosis for an anomaly in a species of DNA originating from cells of a given type may be performed, in each case from a sample from an individual comprising a species of DNA originating from cells of a given type in admixture with differently methylated DNA not originating from cells of said type, the DNA in present in said sample being treated with a reagent that differentially modifies methylated and non-methylated DNA as set forth in any one of items 1 to 47; said operation comprising the steps of:
    receiving: (i) one signal representing the essentially simultaneous quantitative detection of methylation at two or more DMRs as set forth in step (b) of any one of items 1 to 47; and (ii) one signal representing the essentially simultaneous quantitative detection of total DNA using at least one other region as set forth in step (c) any of items 1 to 47;
    determining a parameter from the signals (i) and (ii), wherein the parameter represents a quantitative amount of said species of DNA;
    comparing the parameter to with a threshold amount and/or reference distribution of amounts; and
    based on such comparison, determining a classification of whether, respectively, (x) an increased risk of an individual suffering from or developing a medical condition exists; and/or (y) a diagnosis for an anomaly in a species of DNA originating from cells of a given type may be performed.

52. The computer program product of item 51, wherein said operation further comprises the steps:
    receiving a further signal representing the quantitative detection of total DNA in a standard sample of DNA as set forth in item 22; and
    comparing said signal with the signal set forth in (ii) of item 51, so as to determine said parameter that represents an absolute quantitative amount of said species of DNA.

53. The computer program product of item 51 or 52, wherein said operation is for determining if a diagnosis for an anomaly in said species of DNA may be performed, and further comprises the step of determining from said parameter a number of random and/or enriched DNA molecules to be sequenced from, preferably from a separate aliquot of DNA of, said sample as part of said diagnosis.

54. The computer program product of item 51 or 52, wherein said operation further comprises the steps:
    receiving: (i) one signal representing the quantitative detection of methylation at a second set of two or more DMRs as set forth in step (b) of any one of items 38 to 46; and (ii) one signal representing the quantitative detection of total DNA using a second other region as set forth in step (c) any of items 38 to 46;
    determining a second parameter from the signals (i) and (ii), wherein the parameter represents a quantitative amount of said second species of DNA;
    determining the relative amount, preferable the ratio, of said parameter and said second parameter;
    comparing said relative amount or ratio with a threshold and/or reference distribution of amount(s) or ratio(s); and
    based on such comparison, determining a classification of whether an abnormality in said species of DNA or second species of DNA present in said sample; preferably wherein, said abnormality is a chromosomal abnormality; more preferably wherein, said chromosomal abnormality is associated with a foetal abnormality and/or congenital disorder; yet more preferably wherein, said chromosomal abnormality is selected from the group consisting of: a trisomy (such as trisomy 21, trisomy 18, or trisomy 13), a sex-chromosome abnormality (such as Turners syndrome, Klinefelter syndrome, [Noonan syndrome,] Triple X syndrome, XXY syndrome, or Fragile X syndrome or XYY syndrome or XXYY syndrome), a chromosomal deletion (such as Prader-Willi syndrome, Cris-du-chat syndrome, Wolf-Hirschhorn syndrome, or 22q11 deletion syndrome, Duchene muscular dystrophy), Beckwith-Wiedemann syndrome, Canvan syndrome, and neurofibromatosis; most preferable wherein, said chromosomal abnormality is a trisomy, such as one selected from the list consisting of trisomy 21, trisomy 18, or trisomy 13.

55. A method for detecting in a sample from an individual an amount of a species of DNA originating from cells of a given type, which sample comprises said species of DNA in admixture with differentially methylated DNA not originating from cells of said type; said method comprising the steps:
    (a) treating the DNA present in said sample with a reagent that differentially modifies methylated and non-methylated DNA; and
    (b) detecting in said sample the presence of methylation in said species of DNA at two or more DMRs that are differently methylated between said species of DNA and the DNA not originating from cells of said type the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample,
    wherein, said detection in step (b) is made using the same aliquot of DNA of said sample, and in the same reaction/detection vessel, and effectively simultaneously for such DMRs, and using (x) multiplex real-time quantitative PCR; and (y) at least two labelled probes each of which specific for one of said DMRs and that are labelled with the same detectable label(s) for each of said DMRs; preferably wherein, said reagent comprises agent as set forth in item 20.

SEQUENCE LISTING (216 sequences)

SEQ ID NO: 1 - DNA, 20 bp, Artificial Sequence
  Description of Artificial Sequence: Synthetic primer
attgagctgcgggagctggc

SEQ ID NO: 2 - DNA, 18 bp, Artificial Sequence
  Description of Artificial Sequence: Synthetic primer
tgccgtgtggggttgcac

SEQ ID NO: 3 - DNA, 15 bp, Artificial Sequence
  Description of Artificial Sequence: Synthetic probe
acccggctggagcgt

SEQ ID NO: 4 - DNA, 20 bp, Artificial Sequence
  Description of Artificial Sequence: Synthetic primer
ggtcatccaccaccaagaac

SEQ ID NO: 5 - DNA, 20 bp, Artificial Sequence
  Description of Artificial Sequence: Synthetic primer
tgcccaaggatgctgtcaag

SEQ ID NO: 6 - DNA, 20 bp, Artificial Sequence
  Description of Artificial Sequence: Synthetic probe
gggcctcaatgacttcacgt

SEQ ID NO: 7 - DNA, 20 bp, Artificial Sequence
  Description of Artificial Sequence: Synthetic primer
ggtgcgaactcctctttgtc

SEQ ID NO: 8 - DNA, 20 bp, Artificial Sequence
  Description of Artificial Sequence: Synthetic primer
ttaatcacccagcgcatggc

SEQ ID NO: 9 - DNA, 20 bp, Artificial Sequence
  Description of Artificial Sequence: Synthetic probe
ccctcccggtgggtgataaa

SEQ ID NO: 10 - DNA, 20 bp, Artificial Sequence
  Description of Artificial Sequence: Synthetic primer
tgttcactggaggactcatc

SEQ ID NO: 11 - DNA, 19 bp, Artificial Sequence
  Description of Artificial Sequence: Synthetic primer
cagtccatgagggtgtttg

SEQ ID NO: 12 - DNA, 18 bp, Artificial Sequence
  Description of Artificial Sequence: Synthetic probe
gaggtcccattctccttt

SEQ ID NO: 13 - DNA, 18151 bp, Homo sapiens
  RASSF1
gacttggcgtctgaggacagagtccagaccacaaggatctggagctcaggagagactcgtgggccacagcccgagaaagcgctgggaatccaaatactatggcgattggcagtcgcgtaggcgaggcgggctagagacccgcccggatttaggcgcgagccacctccaggggcggggcccaggccgcactgcgcaggcgcggctaacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtgaggcacccgggtcaggcggagtcccggagtcattgtccttgagtcggggagctggggcctgactcgggggaggggctgcccagtgtggaggggctcccaaatgggggagcagagcgttccgagacaggagtattactgctcctgagccccctgtgtcccctcaggatcaggttaggcttcagtaggatccagcccccatccccactcctaatgcacacacgtggacgcacatgcacttaccctctgaggcaggtggaaccagcagcatgagaacctggagaagctgaacatgcaagccatcctcgatgccacagtcagccagggcgagcccattcaggagctgctggtcacccatgggaaggtaccccgaggtcacaggcagggttcctgccttcccccatacctcacctactctacccctccggagtcccctgtgtgcccttcccctctggcctggtacacctgttctccctgaaggacaaagaggaatgtgttacatgtttcattttgtatccctattggacaggactctggcacaccaggctgggtgcagggcatgagttgattagggagaaagctgtaggtcctagaacagcttaggcttcaaggggaaggcccaaatgctaaaggcatctgtgaattgactgtaaggctggtggtggggaaggggtggggaggggttggggagggcgggagggaggggagataacctaactggaggtggaacttcggcatggaaggaagcagccttcccaacatgaaagggggaagttagaaaccagggagatgcctggctggaacatggaccagggagtgtcaccagcagatgacctgagatatcaattgaccaaaaaaaaaaaaaaaaaagccgggcatggtagctcatgcctgttatcccagcattttgggaggccaagacgggtggatcatctgaggtcaggagttcaaggccagcctggccaacatggtgaaaccccacctctactaaaaatacaaaaatttgcagagcatggtggtgcacacctgtaatcccagctactcgggaggctgaggcaggagaatcgcttgaacctgggaggcagaggttacagagagccaagatcatgccactgcactccagcctgggtgacaagagtgaaactccgtctcaaaaaaaaaaaaaaaaaaaagaaaggtcctttgcaaaagaaagatggaactcatactaggggataggataggaacagggcactgtgaagggtcctgagtaggagtgaggccaaggcacacaagagctttggaggaccacagacagggactagagggagggcatgaggagaagggctggcttgaaagggatgcctgaatgggcgggcagaggataagggtgcaggtgcaggcagggcaaggcagtctgggaactgggcaggagccagtcacataagcatgagggacatccacagaggtgttgggagcagctggtaatgaaggtccaaggtgcaagagagaagtcaggaaggatactcatgggtctggaatagtttaggggcccagcagtgtttggggatatcagggttgagctgagccggggatgggagggttgccaggcaaaggtaggcccatctcatccctgtcctttaccctacccttcaaaggtcccaacactggtggaggagctgatcgcagtggagatgtggaagcagaaggtgttccctgtgttctgcagggtggaggacttcaagccccagaacaccttccccatctacatggtggtgagctgggcccctggttcatacctcttctcactccttcagagggctctggaccggggaggagagctggtagcccctatcccttcctcaggccctgtccttctctttatctgacaggtgcaccacgaggcctccatcatcaacctcttggagacagtgttcttccacaaggtgagggactatctctgcccatgggccacagttccgggtcagggcctggcaggaagggagattgtgtctgtgtggggaaggcatcagacacagaaagtttccctcctccttttcccaggaggtgtgtgagtcagcagaagacactgtcttggacttggtagactattgccaccgcaaactgaccctgctggtggcccagagtggctgtggtggcccccctgagggggagggatcccaggacagcaaccccatgcaggtgggttgaggttacctagggttgtgaaagcctaggtctgggttccccaaggcctgcgcaggtgagggtggcccagcgtgaacactgtgtgacctcccaggagctgcagaagcaggcagagctgatggaatttgagattgcactgaaggccctctcagtactacgctacatcacagactgtgtggacaggtgagcagtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaaggtcagactccctccgcaccagcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacaggtaggcactggaaagttagctgctcaggaccactgtcccactttaccagcaccttcctgccactctccacttctctctcctagatcccagaaatctgggagcggctggagcgagaaaacagaggcaagtggcaggcaattgccaagcaccagctccagcatgtgttcagcccctcagagcaggacctgcggctgcaggcgcgaaggtaaggcctgtggaaatggcagggagggtggaggggatgcaggaggcatggatgtgggtggggtgcccccaccttccagggccagtcagaccttcctgactttcccccaggtgggctgagacctacaggctggatgtgctagaggcagtggctccagagcggccccgctgtgcttactgcagtgcagaggcttctaagcgctgctcacgatgccagaatgagtggtattgctgcaggtgagggtatcctagaaccttggacctctaagccctactcccacatcccccacatgcattgccatcctcaatacccacctgcctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacgggtatctccgcgtggtgctttgcggtcgccgtcgttgtggccgtccggggtggggtgtgaggaggggacgaaggagggaaggaagggcaaggcggggggggctctgcgagagcgcgcccagccccgccttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgtgagtagtggccccgcgcgcctacgagagcggaaggggcagccaaggggcagcgcagtcgccgcgggtcaagtcgcggcagagggggtcggcggggacagctcccgaggactaggtccgttactttcgccccatcgctgaagagtgcgcgaaaatggtttatcccttgtcgcactccactcgtatctgggccacagatgagcagaggtggctgcttatatgtaaaaatacgctgattttaagtttcttatctttaaaatgccttggcccttcttgagaaagggtttgtgcctactgtcctcggagtccatcttcccaggcttgcctcttctcaaacactcatgaccccctccagaacctttagggtgaagggaaattaccacctatgggagggagcctggaaaaatttagaacctttggtgggccccctgcaagcaggagttttgttgagtctttatttagcaaacacccttttctgacccagtgaatcagatgctaaaatatgcacgcagccacacacccagcagtccttctgcacccctgggaatcgccagcaagcaaaggttgctctcccctgggtagacaccagctggaatcaccaggggtgcttttacagtcctccccgctagcctggatcccaccgcagacctgttgaatcaactgctgggagtggaccctaggcatcagtaaattttaaaaactccccaaattattgtaacatggagtctgggttgagcatcactgctctggcctatttaggaacttgtggatggatagtgtcccaggtctgtgtgtgcatggagaccctctcatccggtacaagaggacatcacaaattcagctggggggagcacaaagttgtgacagaatgcaaagaatgaacaaggggccgagcgcggtggctcatgcctgtaatcccagcacttcggaaggcggaggcgggtggatcacctgaggtcaggagttcaagaccagcctggccaacatggtgaaacctcatgtctactaaaaaataaaaaaaaatgagccaggcgtagtggcgggtgcctgtaatcccagctactcgggaggctgaggtgggagaattgcttgaacacaggaggcggaggttgcagtgagccgagatcgtgccactgccctccagccttggcgacagagtgagactctgtctcaaaaaaaaaaaaaaaaaaaaaaagaacaaggctgggacattgcagcgttctcaaagagaaataaagtagccatggagataagaagcaggatgatttgggcatgtttatcagaggtagagacaagggagaaatcaaagataagtttgggcttttgtctccagtaactgggagcctagtggccatttttgctgcaaagaggaagctgggcaagtgtagcagtgaggctgaagaaaagggaattaaattttggccatgttcacttgaaacgtcttttagacatcctagtgaaggtactggcacggaggatctagtctgagggtttaggtcagtgtttcagccgtggatctggggcagatgaatgtagacagaccaggccagtgatcaggactgagcccagacttcatcgtgagatatggaagttgagtcagaatctgcaaaggagctgagcaggagctgcagggggtaggaggaaaactgggagagtgtagcccctgggagtcaaagggagcaagcttcaaatgatgctgagggggtgagaatggagaatggaacactggattccatttggtagtacacagatcgctgaggaccctgtcccgggcagtttcctggaggaagaggcaagcctggctggagtgggtagaggggagagtgaaggcgaaggattagagtgtatagagaccagtgtcttggtctgaggggagtagagacaggtgacaaccacagggcagacgtaggttaaaggtgtttagtttttccttcaagtaaatgggcagatgtattccatatacgttcccagtgaagggccgggtgcggtggctcaagcctgtagtcccagcactttggaaggccgaggcgggtggatcacctgagatcaggagtttgagaccagcctggctaacatggtgaaaccccgtctctactaaaaatacaaaaattagctgggcatggtggcgggcgcctgtaatcctaggtactcaggaggctgaggcagaagaatcgcttgaacccaggaggcggaggttgcggtgagccgaaatcgcgccattgcactccagcctgggtgacaaaagcaagacgcagttttttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaagtattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcagactttttacctggaagctttctggctccaaggtattaggcctgtggagtgaaattagactcagaatatgcctgacctgtccacaggtaattggggaacatctgacttggttgtctcagtaaggtgaccgttttgtagggcccatcttccatacaaactgctgtcagggatcctaccagagatcattcagccaagagcctgacatcagaaagcccagtcctagcttgtgtgaacatgaggtgctagtcttctctggggagggtctgctggcttggccatcccttctgcagcctgtacactccccttttgccccttgcagtgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcctgctgttggaatcttttatacatataaagtttttgtagagacatgagtctctctgtgttgcccaggatcctcccaacttggcctcccaaagtgttgggattacaggtgtgagccaccctgcccagcctggactctttattattataggcgcagagctgcagttgcccctcatggtgccagaagttgccaagggtgatggacaggctcccaggtgtcttgcaaagtcaccatggaccaatttgtgaagatgtagtatgcatacatacttggtcatcactcagctccctggggctcaggttgtggtggagacaaaaatggactgcagttagaacttagggaaactggctgggcatagtggctcacacctgtaatcccaacactttggttgggctaggtgggcagatcacttgaggccaggagttcgaggccagcctggccagcatggcgaaaccccatctctaccaaaaatacaaaaaaaatttagctgggcgtggtggtgggcgcttgtagtcccagctactcagaaggctgaggcaggagaatcgcttgaacccggcaggcagaggttgcagtgagtggagatcacaccactgcactccgatagagcaagactccaactcaaaaaaaaaaaaaacggccgggcgcagtggctcaggcctgtaatcccagcactttgggaggccaaggcgggtggatcacctgaggtccggagttcaagactgcctgaccaacatggtgaaaccccgtctctactagaaatacaaaaaaattagccggcatggtggcagatgcctgtaatcccaagtactcgggaggctgaggcaggagaatcgcttgaaccctggaggcagaggctgcagtgagccgagatcgtgccactgcacattatcctgggcgacaagagtgaaactccatctcaaaaaaaaaaaaaaacaaaaccatcccttcaacacacacacaccacgctctgggagaaggtgtggcataactccttcaccaaatacagagctgccaccgtggaccagacactgctcgtgataccgagggtatagctgttaacaattcttgctttcattaagcatggactctgctgggtttgaaaacactgaattcgaagttcttcagaactgaatgtaactatgtgaatctggccagttccttaattttctttcaacttggttagttcacataagcgtggcaatcgcaaaaatacagctgtgaaaatagaagccagatgggcacccggcggtctggccttaggccctgaagtgcaggtttgaggattggtgcttgcgaagtcctgctaggcctgaactcaggtgttgggggacgtcagagccgccaaatacacccaaaagaccgggaggactcacggccaccactttcctcggtgggagctgtcccagctggtcagatcgcgcttgctgggacctgggatctcgcaacgcatgctgggatgcccagcatctaagggcgcccattggtcccgcccccacgacttgagcaacagccaatcagaggtggcagcgtgcggaagcggaagtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctg

SEQ ID NO: 14 - DNA, 20911 bp, Homo sapiens
  TBX3
agggatctccaggctgtcatggttgctgggaaagatgagggagggaaagggggcagagtacggaggcaccaggtcagaaagacaggagagaattcagacaggaccaaaacagccagaaaaaataggataaagaaggtagaaaaaaaaaaaaaacaaaacaaaacatgagaagttaaagcctgggaaatagatacaagacaagaaagagaaatagaaaccaagaacaagattgatgaaaggaggagaagagaaagtagaaggaaaaagaataagaaagattccagacacgcattcaaataatcctaaatggggatgagcagaaagacaaggagaccaaaagaaaagggggggggggggtggtggggaggagaaagaaaggaatggaaaaagaaacaaaaggtgaatgtcctgccctgtctgtctggtccaaccaagaagctagtgtctgccctggagggaggaaaggtgggggagtccagcctgtctccaagggactgacaggcagcttctggaccagagaggaactaagctctcaaagcaagctttggggaggaggaagggatgggggtgcatggtgagtggagactcctggaggaagagcaagcctccactgggttcagcactgccagggggagagtcagggttcagggtagcatagcagtgctaatgtatgtaccccagaggggtagggggtgctagggcaatttgcaggaggaccacaaacagtaaactagagagctacttccctgggatccgtgataagaaaatcacttcctcaggtgggagaattgagcccgaaagagaatgggagcccttggggggcaggcacctggtcagtttcaaagctcgtcaatatcaaaagaggctgggatcctgagatcaaatgggctggggcactgggcagaaacgaggagccattgccaaactgccaggatgaccagaacgcccctcccccaggaaaagttcatatatgaacccacccctgtatgaaacttcttaattaggtctcatacccccggtgaatcttggatgcccttctgtcaacagaattcccaatttagtgacacctcggactgaaaagagctctgcggcaaacgggggtgaaagtttaagagggaataagcatataatactcccttgccagacctcacacatgctgaagggaatatttacagcaaactggccaaagcaaacgaccccgcctacccaccatccttttaccctcctccccgccctttttgtaaactccagataaacaccatttgatcacaaaagggtcggtttgtcccctttatagtttgaggcaggcagtgcggcagggaaaagtggcgtgggctaagcttccgtctcgggcaaggccagcttctttgctggcaccgtggcctgggctaaggacagttgatttggttttgtttcccccgacccccaccccgaccccacccccacaaaggaacattattttcagggtcctccccccacccagctttaacactcgcctacttgcacccgcactactttaaatgctgcgggcattgcagatagagaggtttttcagttaatttacttttttaattctagagctacaattaagtgaaaactctttttgcgaaaaggtggaggaatatttcagagacgccagaaattatctgggtcttttctgacccggaatctgccctctttctcccttctcctccccttaagtcacccttttctgggactctgttgaagggcaggctctttcaacgtctctagtctgtcttttgttgagtgtgagaccgaaggaaagaggatcgaggggtctgcagagagaaaaagaccgcagatagccggcagctggcgcctaatgccggggtccggggagcgctggcctcgtgggttctcctggaggccaggcccagcacaagccttcggaacacgctggccaatgtttaacccgaatgcagtggccaccaggccgcttttgtttgttcgcaaattaatcacccagcgcatggccggcgccagagtgggtttatcacccaccgggaggggggcgcgccgggcacgcagagacaaagaggagttcgcaccttcccgcttttgatcccagaattacggcggcctccctgcctaatacgagcctcctggggccgagtctgggaggtcagtcataattggcggaagtttgcagaccattagcaagatgtcgacattttcgattcgaaccccgcaaactttcctctcgttctctgcttcgcgcgctggaggttggtgtgggagaggagatgggggtcagaagtagcgatctggggtgatcacagggttaagttagagctatgggcaaaaaataggcaattgagggaggaggacagtgtgaggggcagaactccctctcagtccacccgcggagccaaaaacaaatctagacatttttaagtaaaatccgcaagctcccctcccatttccaaagctgacagctggccagaatgcagaggaatgtctctctgctgtgcgtgggacgcttgggggcaccgagtgggtgaggaggaggtcggtcacagtgtggttgtagaactactttgcttccaccccaagtagtggggcagagattggcctgcgagggcaggcaggcaaaaccagatcgctgggatttggggccgctcttgaaagagcagcgaaggggccccaggccccggaggcgagcagtctgggggagggggtgcactttttttttctatttctttcttttcttttctttttcttttttttggggcgggggtccccagagactcatgaaaccctgcagtgacttccgtgttctgtgtaaggcgggaaatggcctggcctttcgcacccttcaggtggggaggaggggatgcgggagggggtgttatgagccaacactctggggcaccaccacctcgtaattttccctctctctcctttctctattttaaccactggcagagacagagaggacgccagagaaagacagactgaaagggaaagaaaggggcgagatggcgagccagacggagttcgcagaaccacactattctctctggtgacttcagggaattctcaacgctggcgccaagctctcttaaccatgtgcgtcaaaaatgcgaggctggagaagcctgtcgcctcaaaagatcctcccctatctcagcgtggttggcccacaagagcacttcattttcacccttcccttggtgccacgttggggtttcggggttgctgggggttgcgcgggtgcacaaggcaaaatgcgagagaggcctgtgctggcctacagagacacacacatccaaagccctgagtctcttaaacccctaagcccccagatcagccctttctccgttccctttccatcgaagaagctttcatctcaggaaagataaaagaacattgttttcaagatttccctccatctaagcaaggatggtccaagacattggcccccagaatcaagaactgtgggcttaggcgaatcctctgaccccgaccgggcgctgcggtaacagagttggtaattcggcgattggtaagatccggtcgtttccctcccgtccgcctaagaggaggcccccaccctacccgtactaaaaacagtcaactcgcctctgaggtgggggcgtttcacggtttgttttacaaattcaccctccctccccgacttctggccagattaagtccccggggtggagaaagaactgaggcaccgagagataagtgcgatgcctagagaagataccaggctggcgcgcctcccccaacccaatcgcccaccccttaccctgtgctgtgcacccagccgggcctcgaggtgagggcagcggcttggaggggacaggctcagaacccagtctctcgctgtgctcgctttgtccagatcctccattctcttctctacacccacacccacatccaggtggaatatgggggcccgcatgcaaatgaaagacgagatccaaaagggctggtaaatgcatttcataaaaatcccaaatccatcttccccaggagctcaggcagggccagccgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggtaagcagtgggggcctcctcccctaagctgttggagagttttttcctccctttatttctctgctcccagaacagtcggttggtcggttattacggcttggacgaaaagttagttcccctagaaatgtatgcacagacttccaggccctgccccggtggcaggaaatttcagcttacctgggcatctgcatgggtcttgcatttggtctgcatcctgggttccctcccgaacagacagaatttttcagtggagcacagacatccctgcagggagcaggaaagaaaaaaaaaaaaggcactctactgcaagaaactcactcttcaaaccctcctggaacatccttatttctttgttgatgttgtgttgtctgttttattttgttctcagagagaaaaacttaaagccctttccttttgtgtgggtattgggaggcctgacaccattccccggccctttctgccctccagtctagcctctgggtctaaaggggcctgctgctgccctggtcagagagaaatcgaagggcattttggtttgtttgcccacactacttcacgtgtctgtaacccaagggcgagttcagcaggcaattttgcataatttaagattatgtttgcagacttaaggagccagtgaggagacacacaccttttttttaatgtgtgaatattatcaaccatattttacataatgtttaaaggtccttgcctgaccaaaacctgcctggaagagaagatcctgtaatagtcatttaaaatcactgattttttttttgtaatagcattgaagcctgtaaaggcataaagttgatacaaaaataaaatccccttcatgatatcttaagcgttctgtctccttccaagctaaatgaggccaaagtttggcataaaatcctcctcaaactcacaagacatttagtcagttttccagcaaagtgcttccttgcttccttttaagtcaagactacagaatgccaacccttctgtgaaattaacagcaatgtggtggcacagtcttgcggttttggactggcctaagaagtgggggaatgtgttagcagctccacgggcagatcggttatcaggcccaggagtgcaccgaagtctgcaaaattcgttctgggaactcactgaagtccagtttcacttcgcccacagcgggattgctattctgcagcagggaggggtgcaacttgacgttcatttccttgataagtttaacattttctcatcaatgggtggtggaaaattctagtcttaactgaccgcgctttacaaaaatcttaccccaacctgtttagatctagatacccacagaaaaagacatgggcaagaatttgctctcaggagggcaatctgtaaagtcaagcaaggacaaaaaaaatattgaagaaattgttagacaatgtagagaattgcagtgccacaatgcatttgttttgaaccttgggacgtctaaatatggcgaaactgagaatatttaatacgttagttgtggaagaaaacgattttgcaaccagttgcctcactctgaaacatgtaagcttatcagtcacaatataaagtcttagacttggtttcaatattatgtgatacataggaaatcaaacccaagattacgggtggtttatctttctttttcttttctattctttcgttttataggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccaggaagacgcgaatggcgcggaaatatcttcagcgggcaggaattgcatttgaagcccttgatttgattaaggcataaatattcctctctagagttcagcctttcagggctttaagtggattgggctcgtcaattagtgggcgcttaaagtactgaatcattttgtaaattaaaatgcatgtttttctctatcttttaagactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacaatgacacctcgaggagacagaaaaacaccttgactaggtaggaacaatgctgagcaaaaaaacgccatactaattttgccacagagaaactcctagaactgctgtcattgatgccacccactcctccccccctcttgggctttgtcctgtctgttttaaggttcatcttcttccccttggggaagaaggatcaagaagtcacattcaaaaggaaccagctaaaaatttaaggcaaaagccatttgggatcctgggaggagaatcctagtagagaccagcttttctcccctagccagaaatcctgagtagctggtctggtttttattaccttttatgctgctgtgttatgatgtgtgtgtgtgtgtgcatgtgtgtgcatgcatgcgtgtggttggaaaaacctaccctgatcacagggtcatattaatcgagttgtctgaggcttttgagttggggtggccaaagtcaccacttcatttgaattccccccctcccccaggcctgaatctggaggttagaaggatccccaaaagggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgaataccaaaacatgatcttctctccctgtgaaacctgaagtcttcaatagagcaatttattccaagaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattgtaatttcctcaaaccaccccccaggcaaagaaaaaaaaaattaaactcactcccgcactcactcccgcacaagggtagtgaaaccccataaatcatttattggattcatggaaaaggagtgtgtgtgtgtgtgtgtgtgtgtgtgtgtgtgtgtgaagggagtatgctataatttatgattaattgcactgtataaaaatcaaaatgaaagcataattttaagatctacaggttttccctcttgatgactttgacaacacttccatgtctaaacccaaactgttggctgcccaaagaaaagaatttctttgaataatttcatccccaaatccctggtttggcctcatataggagatacaagccctgccacagtttccttattatctcctttccctggcatatctatatgacttctgttggcagtcacatctctagacttgttgagttgggaaaaacaccctcaaaacattctagaaaatgagaacaatgtctctgtcttgcttgtgtctcttccaatagataacccagttaaaaatagacaacaacccttttgcaaaaggtttccgggacactggaaatggccgaagagaaaaaaggtgagttgaaacaattatttattagatagtttagaaaaatccctttttttaggatccaactctgaagtgttagaagtgagatgcaggcacttatcctaagagcgggtggaaatcattcactttccccactgctacatgcttgccgctatcagtatacccaggacaagtacttttcctacctccttacctttaaggaaattaactaggctacaccatacttatctctggaagagaagcatcagggataatagattatacagggatgcctattaattcctaattaatttaagttcatcctaggcaggtcccagaaagaaccatgccattgagaaaatacttgggaatttttgcaatcctgtcttccaaataccatcagacagagctggggacttcggaaagatgtatggctctctccctccttcgtggggacatgtatcattttgcattacgtagacagctggagagtatatgaaagagggtctcccctcccccaccccctttcaaagaatttctaaaatccagaaaatcacccccaaatttttaacctatccccttggggcgggcattaaaaaataattgctaacagctaaatatatttttattccaattaatttgttagtaaaacgattacagtaaagtgcagcatgaaataaccacttcctcccaatcttagccaccatccaaaatttgggtatgctggggacagacagcgttgtgtttgcaggattggacacccggttctccctatataaggctggcagtccagctgtctctgactagatccagcctcttctcctgcttttaaataaaatttcacagcccaagcaaatgccttttcctaatgaaaccccatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccagggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgtttaaagagcaagcagtatttatttggaaagacacacacacacacacacacacacacacacacacacacacactctcaacgggaagaaacctgttttttagtgaaataaaatgcaagtcctttatgtcttcaatccatttaagctttaaacataaaataggatccctttttcttttcttctggtggaacacccacagagggtgtggtaaaagcgaaaaaagaatctatgatcgtccccgggctgtgagccatctgtccgacactcatctctctctgcagggactggggcaaatacaaacggttcaactgagtactggtgttgaaggacaggtgtccgttctgccattatcaattcagatgtcagggttcttgccaaacaaatccttccagagtaattcacaaatttgtggaaggtgctgctctctgtcattcactgattttttgatagtaattagaatatgttccagctgtgagttttaatgttactttttacttttaaaaagttaatttgcaatcgaatggggagatgcatgtgaaatctgccactgtaggaactcaaaaaaagaagtaaaattcattaaaataagaagagctactgattaggggattgtccatctaagggaaagtttaaactctgggtaaatactttaaattcataatcgcttattgaattttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcaggtatggatccttcttcctgcctccaccagtctttccacctttcgtccagtttccctgtcctttgccagcagaccctcacccgatccctttggcctagtagctgtaataatttttactgagccattaccgggttcaaggcttagctcatggagttattatgacttcattctccccattcaccccaaaaatctttaaaatttttccgaagttaaaggctgtttccagcagagtagataggtagtaacaaagataacagctggacacagcacttactttcaggcattcttctaagtgcttgctctgtattgactcatttgacctaacccttcaggggtactattatcacctccactttacagatgaaggcgaagacgcccagagatgttgagtgacttgtccaaggtcacacagcgggtacatggtggagctgagactcaaccccaggctatctgactccagggcctctttgagggtttctgattttagcttcagagctgacatgtctcttaagtgtctcatagccaacccttccccaggaatgggactctaggcctggggaggggaagtgactacttcctgagtaggagttcagtcttgattcctccagcctttcctcccagttcgaagctcttctccccacccccaaccccaagcaggccagcctattcctcgaagggttaatggtttgtgcacacgtgggaaatgtcagaggacagggataagcagggactggggcaggcctggaggcctgtgtgtggctcagacagctgtgctggggggaggtctcaggcggctggaaacaccctgaactcgatgaaaaggttctatgaggttttgcatgctgttgccttttgttttgtctgagcacattcgtctggtctcccttccctgcgccaagaaaccagattggcctccccactccagggaggagggagctgaggaaaggcttggcttctggcatttctcaattcctcccatctcctctgctggcttctccgggagaccctgtcctaggtgggcaggtggttggtacaccaaggactacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaagatcttcactgtctgttttttttgttttgttttgttttgtttggagaaacttctaggattggggtgggaggatgggggttggggaagaagaaagatttaaaaaattattcctactaatttatgtcctccggcttccccttggttacctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttgggccttgtgttaaatgttttttctttgggaacctttcctgaagatggacagtcaggggagggtttagtatcttcttgttctgagtttacccccttcccttcgcctttaaataattaagaccgcccccagcgaaccaaaatgagatgtcactcaagttacaaagctaaaaacaaaagtcccttacttgagcgaagggagccacttcaatctgaaattacttttcctttaaattagggagcaaagcagggagacggaaaggggcctgatgagaatacagaaagaagggtaatttcagatacttttaagttttaatggaaaaagactgatgtgctccctaagtcaggttttcccacccgaatccgaccaaaagtaagctcggcaagtacgaatgtttttcgttttaagctcgccctcagttttgacatcaatctggcgaatccaagtcgaaaataccttcttgcaccagtgtgtttggctcggggaaaaggccagcagaatgccccagcagtccgagcgggcttggctaggcagcaaccctccaggttgtagaagtggacaagacgcaacgcctttccactcggcaaccccccacacagcctgcagtccctggtgcctcaaattgaacccggctggcccaaggcgcccctacgaggccccatccatcccgagttgtgcgtgcaaagcgcggccagctccgcgaaaacttagctgtgtcacgcgagggaggagggaaattatccccgaaaggggaaaggtaattccagggtgcacatttcaccccctccacggcaaaagtcacccaggaggctgacatcctcccctagtctccccttcaaacccgtctccaggctgttcggggagttgccttttgaagttcaatttatctttgaaacattcaataaaaaatgatgaggcactgtcagtcttttggtctcccgacccccagcctcgcctccgaggtgtgtgtctgttggggggcgggggcggcacgggaaggttcgagggttagtccttagcccttttcttgccctgggggccatgacgtgaagacccagctggagcctgcctggcggctgcctccctccccaccccccacccgccaccccctggagcccgccagcccggccccaagtccctgtcaccttcaggcctcttgaatgaccggagaggaggacgccccctcccttccctcatcctgtacttggaagggatcgaggtcgagaccttttggagagcggggcaaagccccttccatctctggccaggcacgtggggacccctacagcctcctctgcgatgtctccgggggtgggagggaagacagacaaccagagtatgttggtgcggagtcgcggggggggggaggggcggggtgcgctgcgggggtggcagggcctgagctgagacgggccctggggacctttgaggctggggctcccccgaggactgggagatttccagggcgcgctccttctgcgcagcggctacagcctgaagggggcagctctggatccagcgacaacgcgcggtgtccgcgcctctgagaaggtggtagttggctggttgcgctctcccgaattggggaaaaaagaactcagcctccaaaagggaagaaatgctttgcttttctcttctttctcagtccaaatttgcttacctcctcccttctctccccccgcccccgatttggggaccctgctcagacttgtgtccagcctctcttactggcgttcctcttttttttttttttttttttttaatctcctgtgtatctcatttgtatattgtgatgttaatgagtaactcctgtagcgctgatgggcggggggtggaggggatgaacggctcgcagtctctctggattttgctgcctattactcacctggcgccggtcgcaatctcgccgcaggctttatggtggctgcggccgccccagaggccactcagggcaggcgccttcgccttttttctgggcttcgagtgccacctatctgtct

SEQ ID NO: 15 - DNA, 305 bp, Homo sapiens
cagcaggcgcgctcccggcgaatctgcctgaatcgccgtgaatgcggtggggtgcagggcaggggctggttttctcagccggtcttggcttttctctttctctcctgctccaccagcagcccctccgcgggtcccatgggctccgcgctcagaacagcccggaaccaggcgccgctcgccgctcgctgggggccacccgcctctccccggaacagcctcccgcgggcctcttggcctcgcactggcgccctcacccacacatcgtccctttatccgctcagacgctgcaaagggccttctgtctc

SEQ ID NO: 16 - DNA, 336 bp, Homo sapiens
gctttggatttatcctcattggctaaatccctcctgaaacatgaaactgaaacaaagccctgaaccccctcaggctgaaaagacaaaccccgcctgaggccgggtcccgctccccacctggagggacccaattctgggcgccttctggcgacggtccctgctagggacgctgcgctctccgagtgcgagttttcgccaaactgataaagcacgcagaaccgcaatccccaaactaacactgaacccggacccgcgatccccaaactgacaagggacccggaacagcgacccccaaaccgacacgggactcgggaaccgctatctccaaagggcagc

SEQ ID NO: 17 - DNA, 139 bp, Homo sapiens
tttccacaacagggagccagcattgaggcgcccagatggcatctgctggaaatcacgggccgctggtgaagcaccacgccttacccgacgtggggaggtgatcccccacctcatcccacccccttctgtctgtctcctt

SEQ ID NO: 18 - DNA, 292 bp, Homo sapiens
gctggacaaggagcgctcactgtagctctgctgtggattgtgttggggcgaagagatgggtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttctaatatgtacctgtcccgcctacgtcgcatcgagatcgcga

SEQ ID NO: 19 - DNA, 190 bp, Homo sapiens
tgcctgacactgaccccaggcgcagccaggaggggctttgtgcgggagagggagggggaccccagcttgcctggggtccacgggactctcttcttcctagttcactttcttgctaaggcgaaggtcctgaggcaggacgagggctgaactgcgctgcaatcgtccccacctccagcgaaacccagttgac

SEQ ID NO: 20 - DNA, 706 bp, Homo sapiens
tcggcggagagacctcgaggagagtatggggaaaggaatgaatgctgcggagcgcccctctgggctccacccaagcctcggaggcgggacggtgggctccgtcccgaccccttaggcagctggaccgatacctcctggatcagaccccacaggaagactcgcgtggggcccgatatgtgtacttcaaactctgagcggccaccctcagccaactggccagtggatgcgaatcgtgggccctgaggggcgagggcgctcggaactgcatgcctgtgcacggtgccgggctctccagagtgagggggccgtaaggagatctccaaggaagccgaaaaaagcagccagttgggcttcgggaaagacttttctgcaaaggaagtgatctggtcccagaactccagggttgaccccagtacctgacttctccgggagctgtcagctctcctctgttcttcgggcttggcgcgctcctttcataatggacagacaccagtggccttcaaaaggtctggggtgggggaacggaggaagtggccttgggtgcagaggaagagcagagctcctgccaaagctgaacgcagttagccctacccaagtgcgcgctggctcggcatatgcgctccagagccggcaggacagcccggccctgctcaccccgaggagaaatccaacagcgcagcctcctgcacctccttgccccagagac

SEQ ID NO: 21 - DNA, 325 bp, Homo sapiens
agatcccggtgcatttaaaggccggcgtgatctgcaccacgtacctatctcggattctcagtttcacttcgctggtgtctgccaccatctttaccacatcccggtagctacatttgtctaccgcttgagccaccagcgtctgaaacctggaccggattttgcgcgccgagaggtagccggaggcggtaatgaattccacccagagggacatgctcctcttgcgcccgtcgctcaacttcagcaccgcgcagccgggcagtgagccatcgtccacgaagttgaacacccccatttggttgagataaagcaccacttcaaattcggt

SEQ ID NO: 22 - DNA, 663 bp, Homo sapiens
actatgccttgagggtcaaaacgtctggatttcctgatcgatgctgtcgtcgctgtccacggagctactgtcgccgtcagagcgggaaggcacgttcagggagtagaagcgtgggcttgcagaaagggacctgttgctgccttacatgggggccggcagggtagtcttggaaatgcccaagattgcttccgcgcgcgtcagttcagcggacgtgtctgcctggcacgaggaccgttctacaaactcgttcctggaagccgggctcgctggaggcggagctttggtttccttcgggagcttgtggggaatggtcagcgtctaggcaccccgggcaagggtctgtggccttggtggccactggcttcctctagctgggtgttttcctgtgggtctcgcgcaaggcacttttttgtggcgctgcttgtgctgtgtgcggggtcaggcgtcctctctcctcccggcgctgggccctctggggcaggtccccgttggcctccttgcgtgtttgccgcagctagtacacctggatggcctcctcagtgccgtcgttgctgctggagtctgacgcctcgggcgcctgcgccgcacttgtgacttgctttccccttctcagggcgccagcgctcctcttgaccccgcttttattctgtggtgcttctgaag

SEQ ID NO: 23 - DNA, 1985 bp, Homo sapiens
gcaagtcgggtagctaccgggtgctggagaactccgcaccgcacctgctggacgtggacgcagacagcgggctcctctacaccaagcagcgcatcgaccgcgagtccctgtgccgccacaatgccaagtgccagctgtccctcgaggtgttcgccaacgacaaggagatctgcatgatcaaggtagagatccaggacatcaacgacaacgcgccctccttctcctcggaccagatcgaaatggacatctcggagaacgctgctccgggcacccgcttccccctcaccagcgcacatgaccccgacgccggcgagaatgggctccgcacctacctgctcacgcgcgacgatcacggcctctttggactggacgttaagtcccgcggcgacggcaccaagttcccagaactggtcatccagaaggctctggaccgcgagcaacagaatcaccatacgctcgtgctgactgccctggacggtggcgagcctccacgttccgccaccgtacagatcaacgtgaaggtgattgactccaacgacaacagcccggtcttcgaggcgccatcctacttggtggaactgcccgagaacgctccgctgggtacagtggtcatcgatctgaacgccaccgacgccgatgaaggtcccaatggtgaagtgctctactctttcagcagctacgtgcctgaccgcgtgcgggagctcttctccatcgaccccaagaccggcctaatccgtgtgaagggcaatctggactatgaggaaaacgggatgctggagattgacgtgcaggcccgagacctggggcctaaccctatcccagcccactgcaaagtcacggtcaagctcatcgaccgcaacgacaatgcgccgtccatcggtttcgtctccgtgcgccagggggcgctgagcgaggccgcccctcccggcaccgtcatcgccctggtgcgggtcactgaccgggactctggcaagaacggacagctgcagtgtcgggtcctaggcggaggagggacgggcggcggcgggggcctgggcgggcccgggggttccgtccccttcaagcttgaggagaactacgacaacttctacacggtggtgactgaccgcccgctggaccgcgagacacaagacgagtacaacgtgaccatcgtggcgcgggacgggggctctcctcccctcaactccaccaagtcgttcgcgatcaagattctagacgagaacgacaacccgcctcggttcaccaaagggctctacgtgcttcaggtgcacgagaacaacatcccgggagagtacctgggctctgtgctcgcccaggatcccgacctgggccagaacggcaccgtatcctactctatcctgccctcgcacatcggcgacgtgtctatctacacctatgtgtctgtgaatcccacgaacggggccatctacgccctgcgctcctttaacttcgagcagaccaaggcttttgagttcaaggtgcttgctaaggactcgggggcgcccgcgcacttggagagcaacgccacggtgagggtgacagtgctagacgtgaatgacaacgcgccagtgatcgtgctccccacgctgcagaacgacaccgcggagctgcaggtgccgcgcaacgctggcctgggctatctggtgagcactgtgcgcgccctagacagcgacttcggcgagagcgggcgtctcacctacgagatcgtggacggcaacgacgaccacctgtttgagatcgacccgtccagcggcgagatccgcacgctgcaccctttctgggaggacgtgacgcccgtggtggagctggtggtgaaggtgaccgaccacggcaagcctaccctgtccgcagtggccaagctcatcatccgctcggtgagcggatcccttcccgagggggtaccacgggtgaatggcgagcagcaccactgtcctaggacatgtcgctgccgctcatcgtgactctgagcactatctccatcatcc

SEQ ID NO: 24 - DNA, 213 bp, Homo sapiens
atgcgccctctgcacccctagagccagaagacgctaggtgggctgcgcgctctgccaggcgaaggctggagcgcagacggcaaagccgcgcgtttcagccgtggtcgggtccgcaggacctgggcgtggggacaccaccaggcaggagcagaggcaggactgggacgccaaaagctgagaatcctcgatgcccgcgcgagagccccgtgttat

SEQ ID NO: 25 - DNA, 1558 bp, Homo sapiens
ttctggaaaccgggccccacttgcaggcccggccaccttgggttctggtggccgaagccggagctgtgtttctcgcagactcggggagctacattgtgcgtaggcaattgtttagtttgaaaggaggcacatttcaccacgcagccagcgccctgcatgcaggagaagcccccagggcccagggtcggctggctttagaggccacttaggttgttttaagcacatgtgaaagggcagacagcaggggagcaggatatgggtaagatcttcgggtctcagaacaggggctgcccttgggctgtcccggcgccctgggctctgacactgaagggtggaatggaggaaggaatggagaaaggacggtggaactttcgcttcccctctgggccgccttcccagggtcatgcctgagctgctttgatcccagtgtcgcgcatcttggtccgctacctcccaggcgatagctactgggctcctcgctggcctcactgggggccatcccgggcagtggcctgccctccgaggcccgcgggacccagcccagagctgaggttggagttctccgggccacgttccgggtcgcttaggctcggagatttcccggagaccgtcgtcctccctttctgcttggcactgcggagctccctcggcctctctcctcctctggtccctaaggcccggagtggttggcggtactggggcccgtcgtcatctctgcttctaaggcattcagactgggctccagctgggaccggcagaggaggttctcaaggaaactggtgggaaatatagttttctttcgtctggtcgtttaatttaaatgcaacttcccttggggacattttcctggacgttaaccagaccaccttgagatgtcgttgatgacctagagacccagatgatgcgtcccaggaaagttcactgctgactattgtcactcttggcgttatatctatagatatagacctatgtacatatctccaccctgatctctccgtggacatgaaacccacctaccttgtgaaagccctacgggtgacacatgactactacgtctctgtcccaacaggggctgggcctcccctgcctaatagttgccaggagtttcgcagcccaagtgaataatgtcttatggctgaacgtggccaaggactcctgtgatttaggtcccaggaggagcagagacgtccccgccccgcctgggccctgccgcattcaaagctggaagaaggcgctgatcagagaaggggcttccaggtcctgggttagaacaacaacaaacaaacgaaactccacaacagacacgcctgcccatgaccccacgcaaggacataggaagttctgtcgccttcctgctccgcggatagccgcctgccgtctgctgccaccagaacgcacggacgctcggggtggaggtagtcaatgggcagcaggggacccccagcccccacaagcgcggctccgaggacctggaagcgggtgcctgtcgctctccgcaggctccgctctgcctccaggagcaagatccccaaaagggtctggaagctgtggagaaaac

SEQ ID NO: 26 - DNA, 1264 bp, Homo sapiens
ttttttaaacacttcttttccttctcttcctcgttttgattgcaccgtttccatctgggggctagaggagcaaggcagcagccttcccagccagcccttgttggcttgccatcgtccatctggcttataaaagtttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcaggtaagcgcgggcgcgctgcaggggcaggctgcagccctcggctgccgcacgtcccactggccgcccggcgtccccttccttccccctgttgctgagttggtgctcactttctgccaccgctatgggactccgcgtctccgtgttgggcggcggatgctcctgcggcttcttcggcgggggaaggtgtgcgtctccgccgcctcattgtgtgcacacgcgggagcaccctggctcccgcctcccgctgctctcgcgcccttctaccccttagttgatggctcaggcccggctggccagggagcccgggtcactccggggcggctgcaaggcgcagacggagagccgagccgggcgctcactccgcgttctggttcgggcaaacttggaagaactgcgaccgcagtttgcccagcgccacagtctgagtggcgccttctccactcccgcccttgcgccggcaggggcggtggagagacgcggagggctcccccagcccctctctcccctatccgtccttcgggcgacagagcgcccggcgctcgggccgggggcgggcaaggctgggagggaccctcgccggggacctggcctctggacgccggcgtttcaaggctggtttggggacttcacgggctgcctgtttcagatgtggggcgggctttcccgttagggttcctcagtgcttccccagttgctgttggccactcagggcccggggacaccctgccacccggtctggagccggcctcgtctgccagcgaacagccaactttagcgggtggctcagctggggatt

SEQ ID NO: 27 - DNA, 761 bp, Homo sapiens
cactcagtgtgtgcatatgagagcggagagacagcgacctggaggccatgggtgggggcgggtggtgaagctgccgaagcctacacatacacttagctttgacacttctcgtaggttccaaagacgaagacacggtggcttcagggagacaagtcgcaagggcgacttttccaagcgggagatggtgaagtctttggacgtgtagtgggtaggtgatgatccccgcagccgcctgtaggcccgcagacttcagaaaacaagggccttctgtgagcgctgtgtcctccccggaatccgcggcttaacacattctttccagctgcggggccaggatctccaccccgcgcatccgtggacacacttagggtcgcctttgttttgcgcagtgattcaagttgggtaacccttgctcaacacttgggaaatggggagaatctcccccacccgcaacctcccgcaccccaggttcccaaaatctgaatctgtatcctagagtggaggcagcgtctagaaagcaaagaaacggtgtccaaagaccccggagagttgagtgagcgcagatccgtgacgcctgcggtacgctagggcatccaggctagggtgtgtgtgtgcgggtcggggggcgcacagagaccgcgctggtttaggtggacccgcagtcccgcccgcatctggaacgagctgcttcgcagttccggctcccggcgccccagagaagttcggggagcggtgagcctagccgccgcgcgctcatgtttatt

SEQ ID NO: 28 - DNA, 1198 bp, Homo sapiens
agtcactccaggatcagaggccgcgtcggttctgcttggggcatgggcagagggaggctgctggggccaagccccggctggacgcgagggaagaaactcgtcccaggacccgcacgcccatacctggctgtcccagagctcttccctaggccggcaccttcgctcttcctcttccccaccccctagcccttttgtctctttttcagacggatgttttcagtctcaagtggttttattttccgcacaaaaccctgagatcaagggcagatcacagactgtaccggaggctcgggtttccctggactctgtgctgttctgcgtcccagggttggctaggaaggaaggcctgggccggcgaggtgacgggtctcccgcccaggtcggcaggacggggggaggtgtgtcccggtaggtccctggtgagctcacccgtggcatcggggacccgcgggaacccaccgggcgcccactagagactcgggtcctaccctcccccacactactccaccgaaatgatcggaagggcgcgctaggcctgcttccaagggctcagtgataaaggcctcaaaatcacactccatcaagacttggttgaagctttgggtaggtttgttgttgttgttgttgttgtttgtttgtttgttttagcagacacgtcctggaaagaggtcctcagaacccaaaggttcaataatgatttgtggatggattgattatagtctgatatcgctctggttccacagaaacccggagctccttggcccactgttaccccagcagacctaaatggacggtttctgtttttcactggcagctcagaactggaccggaagaagttcccctccacttcccccctcccgacaccagatcattgctgggtttttattttcgggggaaaaacaacaacaacaacaacaaaaaaaacactaggtccttccagactggatcaggtgatcgggcaaaaaccctcaggctagtccggctgggtgcccgagcatgaaaaggcctccgtggccgtttgaacagggtgttgcaaatgagaacttttgtaagccataaccagggcatcctgagggtctgagttcacggtcaaggctgtgggctactaggtccagcgagtccaggcctcgccccgcccccgagctgccacagccaagatcttcggcagggaattcgagaccagggtcctcccactcct

SEQ ID NO: 29 - DNA, 377 bp, Homo sapiens
tttcgtgccgctgttttcaatgcgctaacgaggcacgttattcttagccgcgtccgggaggggatcacattcctgcgcagttgcgctgctggcggaagtgacttgttttctaacgaccctcgtgacagccagagaatgtccgtttctcggagcgcagcacagcctgtcccatcgagaagcctcgggtgaggggcccggtgggcgcccggaggccgctggagggctgtgggagggacggtggctccccactcccgtggcgaagggcaggcaaaccagaagcctcttttgagagccgtttgggattgagacgagtaagccacagcgagtggttagaagtaggttaggaagaaggggaggtaagaaagccgagtagggtt

SEQ ID NO: 30 - DNA, 256 bp, Homo sapiens
gttcggtggacaagggggcagcgcccacagcaagccggaaagagggaggcgcggggccgcgcttggggcctgccgctgcacgccagcctgggcaaagagctgccaccttctgcgggcgaagcgggtcgggacgcaggacggcagcggggctggaggcagctacgtgggtccacacccccatgccctgcaaggctccttggccctgcttctcctctgtctcggcgggagaggagcagcctcggttttacagaatttc

SEQ ID NO: 31 - DNA, 189 bp, Homo sapiens
tgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccccaccagcgcggctcacgcctcagtctc

SEQ ID NO: 32 - DNA, 707 bp, Homo sapiens
agagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccggagctgccctggctggtgattggaggtttaacgtccggaattcaggcgcttctgcagctcagatttgccggccaaggggcctcagttgcaacttttcaaaatggtgtttctggaaaataacaaattcagactcaactggtgacagcttttggctatagagaatgaaactgcttccctttggcggtggaactcttaaacttcgaagagtgaaagaatacaatgaaataaaatgccataagatcactggatttttcagaaaaaggaagaccccaaattactcccaaaatgaggctttgtaaattcttgttaaaaatctttaaatctcgaatttccccctacaacatctgatgagtgctttaagagcaaacgagcaaatcccacctcgagaatcaacaaacccaagctctggccaaggctctccccgcgttttcttctcgtgacctggggaatgtcccgccccatcgctcacctggctcttgtcatctcgctcatcttgaagtgacccgtggacaatgctg

SEQ ID NO: 33 - DNA, 182 bp, Homo sapiens
agctgccctctgtggccatgagcgggtgtccagccccttccaaggctgcaccggggagacgctggttttctgctcgctgtgaccgaacaaagcccctaagagtcagtgcgcggaacagaagagccggaccccgacgggccgagtcccaacgtgaggcacccggcagagaaaacacgttcacg

SEQ ID NO: 34 - DNA, 179 bp, Homo sapiens
cctcggcagcaccggcatggctggaggccagtacggccaggtgtggcgggagggagcgccgtctggcttgggtcgtccatcctgacaggacgctgcaagggcaggagccccgcgccccgtgtcctgcgcccccgctcgaggacaagccccagccgccggtctccgctgggttccgacag

SEQ ID NO: 35 - DNA, 369 bp, Homo sapiens
ctttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaatcccgtcccgcgcctcctcaccctcttgcagctgggcacaggtaccaggtgtggctcttgcgaggtg

SEQ ID NO: 36 - DNA, 176 bp, Homo sapiens
agacttgcagaactcgggccccctggaggagacctaaccgccacggtcttggggaggttccggagggcctcggttgtctgcactcccaacaccaagaaacccctgagacgcgaagctgccagcgtgctgccctcagagcagggcgacgcaaagccagcggaccccggggtggcggg

SEQ ID NO: 37 - DNA, 167 bp, Homo sapiens
tgctcggctggggggctcgctccgcactttcggtgccagaaaatgcccagaggagcggggcggccccagagcctcctttcggggcgcgaggcccggcgcgtgtgtacggagtccagtccccccagggagtggggtgcccgcaccttcccctccgcgctcggagccac

SEQ ID NO: 38 - DNA, 1205 bp, Homo sapiens
tcttgcacacctgcttgtagttctgcaccgagatctggtcgttgaggaactgcacgcagagcttggtgacctgggggatgtgcaggatcttgctgaccgacagcacctcctccaccgtgtccagggacagggtcacgttggccgtgtagaggtactcgagcaccaggcgcagcccgatggacgagcagccctgcagcaccaggttgttgatggcccgggggctggtcagcagcttgtcgtcgggggaggaagaaggagtcccgggctcctcctgcggcggcggctgctgctgctgtgacggctgctgctgcggcggctgctgctggtccttgggggcccccaggccgtcctggccgccgacccctcccccgagaggggggtggctggagaagagcgatcggaagtactgcgagcaggaggccagcacggccttgtggcaatggaactgctggccctgggccgtcagggtcacgtcgcaaaacagctgcttcctccacagcaggttgaggccgtgcagcaggttgtcgctgtggctggggtcgaaggtggaggtcctgtccccggatctggacatggcgagctgactcggtgcacctggctttaaaccctcctccaacctggcagacaggggtgggggatgggagggaggggagcagggtggtggagcgggtggggtgtggtcggggtggggaagggtgtggaggggaggggagggcgaagaacaagaatcaaggctcagcttgactccctcctggcgcgctccggaccccgaccctaggaggaaagtccgaagacgctggatccgtgagcgccaccagaagggccctgtctggggtcccggcgccggttctgcgccctgcggctcctctcgccacctcccacacacttcgtccctcactttcctaaaaccaaccacctcagctcggctgttggcagcaacagcagtggcagcagcgacggcaaagtggcggctgaggccgaggcacctcgtgggctcgtgtccatgccgggccagatgaagggaaaggccgggaagtggggagccgggggtgccctgaaagctcagaggcgaccgacggcgaaggttccaggtcaacttgtgcccgaagctttgcttttcgcagttggcccagtttgggggagggggtaggaacaggggcccgaccagcgtgcggggtgtgcgaatcttagctctccaaaagctg

SEQ ID NO: 39 - DNA, 44 bp, Homo sapiens
cctctgtgttagtgccctcgggaatttggttgatggggtgtttg

SEQ ID NO: 40 - DNA, 5002 bp, Homo sapiens
tgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctg

SEQ ID NO: 41 - DNA, 150 bp, Homo sapiens
aaccggagatctgcttggtgaactgagaggagtccttaggagagcggggacgccaggggccgggggacacttcgctctcgccctagggaaggtggtcttgacgctttctattgaagtcaaacttgaaaatatcagctgccgctggactat

SEQ ID NO: 42 - DNA, 339 bp, Homo sapiens
cgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggt

SEQ ID NO: 43 - DNA, 1961 bp, Homo sapiens
tagaagaggaagactcctctggccccactaggtatcatccgcgctctcccgctttccacctgcgccctcgcttgggccaatctctgccgcacgtgtccatccctgaactgcacgctatcctccacccccggggggttcctgcgcactgaaagaccgttctccggcaggttttgggatccggcgacggctgaccgcgcgccgcccccacgcccggttccacgatgctgcaatacagaaagtttacgtcggccccgacccgcgcgggactgcagggtccgccggagcgcggcgcagaggcttttcctgcgcgttcggccccgggaaaggggcgggagggctggctccgggagcgcacgggcgcggcggggagggtactcactgtgaagcacgctgcgcccatggatcatgtctgtgcgttacaccagaggctccgggctccactaattccatttagagacgggaagacttccagtggcggggggaggacagggtcgagaggtgttaaagacgcaaagcaagaaggaaataaaggggggccgagagggagaccgagaggaagggggagctccgagcccacgctgcagccagatccggatgagtccgtcctccgccccgggcgggctctcgctctcgctggccctcagcgccgcgcagccagcagcatccccaccgtgacgctcgcatcacacccgggcgccggccgccaccatccgcgccgccgccgtcaggaccctcctcccgggcatcgtcgccgccgcggggtcgggaggacgcggcgcgcgggaggcggcggtcgcagggcgagccccgggacgccccgagccggggccggggccggggagagggcgcagcgaggtgggggccagtccagaccgacggcagcgacggagcgggcggcggcggcggcgccggcggcggcggggtggctcagtccccagtctcagacgcgccgcgcagcaggtcggagcagcctccccgggaggatgtccagcggcagcgctcctcgctccagcccttggggatcttccgctgaggcattgaaggcaggaagaaggggtccgtcatcggctcgccgggctgcgcgccacctctgctatcttgcggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatccgcggctcggcccgccagggcgcagagagaggatgcagccgcaaatcccgagccggatcctcgtgccggacggaaggcgtggaagcgggaggggccttcgtgtgaaaatcccttgtggggtttggtgtttcactttttaaaggttagaccttgcgggctctctgcctcccaccccttcttttccatccgcgtaaaggaactgggcgccccctctccctccctccctggggcgcaggtttcgccgcggactccgcgctcagcttgggagacacggcaggggcgcgccccagggaaaggcggccgtaaaagtttcgcggttgagcactgggcctgatgtccagtccccccaccaaattactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaag

SEQ ID NO: 44 - DNA, 314 bp, Homo sapiens
aagaaacagctcatttcggagctgaggacaaggcgtgggaagaagacgcgtttggtttcacccaggcgggtggcggcaaagctgtgggatgcgcgctgcacactccttccgtcatcccgttcccaccttccacacacacctgcgggaggtcggacatgtcctgattgcgtgttcatcacgatggcaaaccgaacatgaggagaacgccactgacgctgggtgcgccggctttcccagccctcgtgcataacggggagggagatgcagaagttttttccaacatcggtgcaaaggggaagctgaggttttcctat

SEQ ID NO: 45 - DNA, 584 bp, Homo sapiens
tctgtcagctgctgccatggggcagcgggaaggccctggagggtgcctgggctgtgtctggtcccggccacgcgtccctgcagcgtctgagaccttgtggaacacacttgacccggcgctgggacggggtcggcccacacgcaccgccagcccgcaggagtgaggtgcaggctgccgctggctccttaggcctcgacagctctcttgaggtcggccctcctcccctcccgagagctcagcagccgcagacccaggcagagagagcaaaggaggctgtggtggcccccgacgggaacctgggtggccgggggacacaccgaggaactttccgccccccgacgggctctcccaccgaggctcaggtgctcgtgggcagcaaggggaagccccatggccatgccgcttccctttcaccctcagcgacgcgccctcctgtgcccgcggggaacaagacggctctcggcggccatgcaggcggcctgtcccacgaacacgatggagacctcagacgccgtccccaccctgtcactgtcaccatcacccatcctgtcccctcacgcctccccacatcccatcattactac

SEQ ID NO: 46 - DNA, 349 bp, Homo sapiens
gaagtagaatcacagtaaatgaggagttagggaatttagggtagagattaaagtaatgaacagaggaggaggcctgagacagctgcagagagaccctgtgttccctgtgaggtgaagcgtctgctgtcaaagccggttggcgctgagaagaggtaccgggggcagcacccgcctcctgggagagggatgggcctgcgggcacctgggggaaccgcacggacacagacgacactataaacgcgggcgagacatcagggaccgggaaacagaaggacgcgcgtttcgagcagctgcccagtgggccacaagccccgccacgccacagcctcttcccctcagcacgcagaga

SEQ ID NO: 47 - DNA, 3510 bp, Homo sapiens
tactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaacaaatgtctgaattcgaaatgtatgggtgtgagaaattcagctcggggaagagattagggactgggggagacaggtggctgcctgtactataaggaaccgccaacgccagcatctgtagtccaagcagggctgctctgtaaaggcttagcaattttttctgtaggcttgctgcacacggtctctggcttttcccatctgtaaaatgggtgaatgcatccgtacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggtgcggctgcgtggggcatcaggttagtttgttagactctgcagagtctccaaaccatcccatcccccaacctgactctgtggtggccgtattttttacagaaatttgaccacgttccctttctcccttggtcccaagcgcgctcagccctccctccatcccccttgagccgcccttctcctccccctcgcctcctcgggtccctcctccagtccctccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgccc

SEQ ID NO: 48 - DNA, 333 bp, Homo sapiens
ttaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctg

SEQ ID NO: 49 - DNA, 385 bp, Homo sapiens
ccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtg

SEQ ID NO: 50 - DNA, 105 bp, Homo sapiens
gcgcaggtccccccagtccccgagggagtgcgcccgacggaaacgcccctagcccgcgggcctcgctttcctctcccgggttcctgggtcacttcccgctgtctc

SEQ ID NO: 51 - DNA, 147 bp, Homo sapiens
ttccctcgcggctttggaaagggggtgcaaatgcacccttctgcgggcccgctacccgctgcaacacctgtgtttcctttctgggcaccttctaggtttctagatattgctgtgaatacggtcctccgctgtacagttgaaaacaaa

SEQ ID NO: 52 - DNA, 365 bp, Homo sapiens
tgggaatttaggtcgggcactgccgatatgtcgccttccacaaggcgggcccgggcctctgctgaccgtgcaccggtcctggggctgggtaattctgcagcagcagcgcagcccatgccggggaatttgcgggcagaggagacagtgaggcccgcgttctgtgcgggaactcccgagctcacagagcccaagaccacacggctgcatctgcttggctgactgggccaggcccacgcgtagtaacccggacgtctctctctcacagtccccttgcgtctggccagggagctgccaggctgcaccccgcggtggggatcgggagaggggcagtgtcgcccatccccggaaggctgagcctggtgcag

SEQ ID NO: 53 - DNA, 418 bp, Homo sapiens
cggttttctcctggaggactgtgttcagacagatactggtttccttatccgcaggtgtgcgcggcgctcgcaagtggtcagcataacgccgggcgaattcggaaagcccgtgcgtccgtggacgacccacttggaaggagttgggagaagtccttgttcccacgcgcggacgcttccctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggac

SEQ ID NO: 54 - DNA, 906 bp, Homo sapiens
agggaatcgggctgaccagtcctaaggtcccacgctcccctgacctcagggcccagagcctcgcattaccccgagcagtgcgttggttactctccctggaaagccgcccccgccggggcaagtgggagttgctgcactgcggtctttggaggcctaggtcgcccagagtaggcggagccctgtatccctcctggagccggcctgcggtgaggtcggtacccagtacttagggagggaggacgcgcttggtgctcagggtaggctgggccgctgctagctcttgatttagtctcatgtccgcctttgtgccggcctctccgatttgtgggtccttccaagaaagagtcctctagggcagctagggtcgtctcttgggtctggcgaggcggcaggccttcttcggacctatccccagaggtgtaacggagactttctccactgcagggcggcctggggcgggcatctgccaggcgagggagctgccctgccgccgagattgtggggaaacggcgtggaagacaccccatcggagggcacccaatctgcctctgcactcgattccatcctgcaacccaggagaaaccatttccgagttccagccgcagaggcacccgcggagttgccaaaagagactcccgcgaggtcgctcggaaccttgaccctgacacctggacgcgaggtctttcaggaccagtctcggctcggtagcctggtccccgaccaccgcgaccaggagttccttcttcccttcctgctcaccagccggccgccggcagcggctccaggaaggagcaccaacccgcgctgggggcggaggttcaggcggcaggaatggagaggctgatcctcctctagccccggcgcattcacttaggtgcgggagccctgaggttcagcctgactttc

SEQ ID NO: 55 - DNA, 860 bp, Homo sapiens
cactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactccgggaaagcgagggccgaggtaggggcagatagatcaccagacaggcggagaaggacaggagtacagatggagggaccaggacacagaatgcaaaagactggcaggtgagaagaagggagaaacagagggagagagaaagggagaaacagagcagaggcggccgccggcccggccgccctgagtccgatttccctccttccctgacccttcagtttcactgcaaatccacagaagcaggtttgcgagctcgaatacctttgctccactgccacacgcagcaccgggactgggcgtctggagcttaagtctgggggtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtacccgccctcggcacaagctctctcgtcttccacttcgacctcgaggtggagaaagaggctggcaagggctgtgcgcgtcgctggtgtggggagggcagcaggctgcccctccccgcttctgcagcgagttttcccagccaggaaaagggagggagctgtttcaggaatttcagtgccttcacctagcgactgacacaagtcgtgtgtataggaag

SEQ ID NO: 56 - DNA, 452 bp, Homo sapiens
ggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctacaaagtggagaagttgctctactctggagggcagtggccttttccaaacttttccacttaggtccgtaagaaaagcaattcatacacgatcagcgctttcggtgcgaggatggaaagaaacttc

SEQ ID NO: 57 - DNA, 1992 bp, Homo sapiens
ttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcccggccgaggactggatggaggacgagaagcagcctgcctctgggcgacagctgcggacgcagcctcgccgcctcgccgcctcagcctcggtcccagcgtctctaaagccgcgcccattttacagatgcagggcagggagacaagaggcatctccgggggccgagtagaatgatggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggccgcgcagcgggtagggtatgggactgggggacgcaacggggacctggccgaatcagagccctcagcagagaacgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggctcaagcctatcatctcagccctttgggaggccaagccgggaggattgtttgagcccaagaattcaaaaccagcctgagcaacatagcgaccccgtctctacaaaataaaataaaataaattatccgggcgtggtggcacgcgcctgtggttccagctactccggaggctgaggtgggaggatcgcttgagtccgggaggtcgaggctacagtgagccgtgatcgcaccactgcactccagcctgggcgacagagtgagaccttgtctcaaaaaaggaaaaaaagaaaaagaaagtaagcttcaaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccaccgggcccctgggcagggtaaccttagcctgtccgcttcggcagctttgcgaagagtggcgcgcagctagggctgaggctcttgcggacctgcggtcgaagcaggcggctgagccagttcgatcgccaaggcctgggctgccgacagtggtgcgcgctctgttccgccgcggccgggccaggcgctctggaatagcgatggggggacacggcctccaactttctgcagagaccatcgggcagctccgggcctaagcagcgacctcaccgaaggttcctgggaacctttgccaaaatcccagcctctgcctcggtccagctaaaccgtgtgtaaacaagtgcaccaag

SEQ ID NO: 58 - DNA, 448 bp, Homo sapiens
ataaaggaccgggtaatttcgcggaatgcggattttgagacaggcccagacggcggcggattccctgtgtcccccaactggggcgatctcgtgaacacacctgcgtcccaccccgatcctaggttggggggaaagggtatgggaaccctgagcccagagcgcgccccgctctttcctttgctccccggcttccctggccagccccctcccggctggtttcctcgctcactcggcgcctggcgtttcgggcgtctggagatcaccgcgtgtctggcaccccaacgtctagtctccccgcaggttgaccgcggcgcctggagccgggaataggggtggggagtccggagaaccaaacccgagcctgaagttgccattcgggtgactcccgagaaagcccgggagcattttggccaatgcgggtttttacctgaacttcagcatcttcacc

SEQ ID NO: 59 - DNA, 395 bp, Homo sapiens
aattggaaaaccctggtattgtgcctgtttgggggaagaaaacgtcaataaaaattaattgatgagttggcagggcgggcggtgcgggttcgcggcgaggcgcagggtgtcatggcaaatgttacggctcagattaagcgattgttaattaaaaagcgacggtaattaatactcgctacgccatatgggcccgtgaaaaggcacaaaaggtttctccgcatgtggggttccccttctcttttctccttccacaaaagcaccccagcccgtgggtcccccctttggccccaaggtaggtggaactcgtcacttccggccagggaggggatggggcggtctccggcgagttccaagggcgtccctcgttgcgcactcgcccgcccaggttctttgaa

SEQ ID NO: 60 - DNA, 491 bp, Homo sapiens
gggaagcgatcgtctcctctgtcaactcgcgcctgggcacttagcccctcccgtttcagggcgccgcctccccggatggcaaacactataaagtggcggcgaataaggttcctcctgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggtaagggacggcgggcggcgggaccccgacgcaccaaggccggcgaggggagggcgtaggggtctgagatttgcaggcgtgggagtaaaggggaccgcaaactgagctag

SEQ ID NO: 61 - DNA, 1284 bp, Homo sapiens
ctcaggggcgggaagtggcgggtgggagtcacccaagcgtgactgcccgaggcccctcctgccgcggcgaggaagctccataaaagccctgtcgcgacccgctctctgcaccccatccgctggctctcacccctcggagacgctcgcccgacagcatagtacttgccgcccagccacgcccgcgcgccagccaccgtgagtgctacgacccgtctgtctaggggtgggagcgaacggggcgcccgcgaacttgctagagacgcagcctcccgctctgtggagccctggggccctgggatgatcgcgctccactccccagcggactatgccggctccgcgccccgacgcggaccagccctcttggcggctaaattccacttgttcctctgctcccctctgattgtccacggcccttctcccgggcccttcccgctgggcggttcttctgagttaccttttagcagatatggagggagaacccgggaccgctatcccaaggcagctggcggtctccctgcgggtcgccgccttgaggcccaggaagcggtgcgcggtaggaaggtttccccggcagcgccatcgagtgaggaatccctggagctctagagccccgcgccctgccacctccctggattcttgggctccaaatctctttggagcaattctggcccagggagcaattctctttccccttccccaccgcagtcgtcaccccgaggtgatctctgctgtcagcgttgatcccctgaagctaggcagaccagaagtaacagagaagaaacttttcttcccagacaagagtttgggcaagaagggagaaaagtgacccagcaggaagaacttccaattcggttttgaatgctaaactggcggggcccccaccttgcactctcgccgcgcgcttcttggtccctgagacttcgaacgaagttgcgcgaagttttcaggtggagcagaggggcaggtcccgaccggacggcgcccggagcccgcaaggtggtgctagccactcctgggttctctctgcgggactgggacgagagcggattgggggtcgcgtgtggtagcaggaggaggagcgcggggggcagaggagggaggtgctgcgcgtgggtgctctgaatccccaagcccgtccgttgagccttctgtgcctgcagatgctaggtaacaagcgactggggctgtccggactgaccctcgccctgtccctgctcgtgtgcctgggtgcgctggccgaggcgtacccctccaagccggacaacccgggcgaggacgcaccag

SEQ ID NO: 62 - DNA, 554 bp, Homo sapiens
tggagaaccttgggctctgtggcctcaaaggtaggggtgatttcgaggggccggcacctcacagggcaggttccaccgcggaaacgcagtcatcgcccagcgaccctgctcctggccctcagcctccccccaggtttctttttctcttgaatcaagccgaggtgcgccaatggccttccttgggtcggatccggggggccagggccagcttacctgctttcaccgagcagtggatatgtgccttggactcgtagtacacccagtcgaagccggcctccaccgccaggcgggccagcatgccgtacttgctgcggtcgcggtcagacgtggtgatgtccactgcgcggccctcgtagtgcagagactcctctgagtggtggccatcttcgtcccagccctcggtcacccgcagtttcactcctggccactggttcatcaccgagatggccaaagcgttcaacttgtccttacacctctgcgaagacaaggggacccccaccgacggacacgttagcctgggcaaccgccacccctcccggcccctccatcagcct

SEQ ID NO: 63 - DNA, 772 bp, Homo sapiens
tctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaat

SEQ ID NO: 64 - DNA, 1362 bp, Homo sapiens
tggtttcctttcgcttctcgcctcccaaacacctccagcaagtcggagggcgcgaacgcggagccagaaacccttccccaaagtttctcccgccaggtacctaattgaatcatccataggatgacaaatcagccagggccaagatttccagacacttgagtgacttcccggtccccgaggtgacttgtcagctccagtgagtaacttggaactgtcgctcggggcaaggtgtgtgtctaggagagagccggcggctcactcacgctttccagagagcgacccgggccgacttcaaaatacacacagggtcatttatagggactggagccgcgcgcaggacaacgtctccgagactgagacattttccaaacagtgctgacattttgtcgggccccataaaaaatgtaaacgcgaggtgacgaacccggcggggagggttcgtgtctggctgtgtctgcgtcctggcggcgtgggaggttatagttccagacctggcggctgcggatcgccgggccggtacccgcgaggagtgtaggtaccctcagcccgaccacctcccgcaatcatggggacaccggcttggatgagacacaggcgtggaaaacagccttcgtgaaactccacaaacacgtggaacttgaaaagacaactacagccccgcgtgtgcgcgagagacctcacgtcaccccatcagttcccacttcgccaaagtttcccttcagtggggactccagagtggtgcgccccatgcccgtgcgtcctgtaacgtgccctgattgtgtacccctctgcccgctctacttgaaatgaaaacacaaaaactgttccgaattagcgcaactttaaagccccgttatctgtcttctacactgggcgctcttaggccactgacagaaacatggtttgaaccctaattgttgctatcagtctcagtcagcgcaggtctctcagtgacctgtgacgccgggagttgaggtgcgcgtatccttaaacccgcgcgaacgccaccggctcagcgtagaaaactatttgtaatccctagtttgcgtctctgagctttaactcccccacactctcaagcgcccggtttctcctcgtctctcgcctgcgagcaaagttcctatggcatccacttaccaggtaaccgggatttccacaacaaagcccggcgtgcgggtcccttcccccggccggccagcgcgagtgacagcgggcggccggcgctggcgaggagtaacttggggctccagcccttcagagcgctccgcgggctgtgcctccttcggaaatgaaaacccccatccaaacggggggacggagcgcggaaacccggcccaagtgccgtgtgtgcgcgcgcgtctg

SEQ ID NO: 65 - DNA, 476 bp, Homo sapiens
gaaagccatccttaccattcccctcaccctccgccctctgatcgcccacccgccgaaagggtttctaaaaatagcccagggcttcaaggccgcgcttctgtgaagtgtggagcgagcgggcacgtagcggtctctgccaggtggctggagccctggaagcgagaaggcgcttcctccctgcatttccacctcaccccacccccggctcatttttctaagaaaaagtttttgcggttccctttgcctcctacccccgctgccgcgcggggtctgggtgcagacccctgccaggttccgcagtgtgcagcggcggctgctgcgctctcccagcctcggcgagggttaaaggcgtccggagcaggcagagcgccgcgcgccagtctatttttacttgcttcccccgccgctccgcgctcccccttctcagcagttgcacatgccagctctgctgaaggcatcaatgaaaacagcagtag

SEQ ID NO: 66 - DNA, 300 bp, Homo sapiens
atcgaaaatgtcgacatcttgctaatggtctgcaaacttccgccaattatgactgacctcccagactcggccccaggaggctcgtattaggcagggaggccgccgtaattctgggatcaaaagcgggaaggtgcgaactcctctttgtctctgcgtgcccggcgcgcccccctcccggtgggtgataaacccactctggcgccggccatgcgctgggtgattaatttgcgaacaaacaaaagcggcctggtggccactgcattcgggttaaacattggccagcgtgttccgaaggcttgt

SEQ ID NO: 67 - DNA, 1246 bp, Homo sapiens
atcaacatcgtggctttggtcttttccatcatggtgagtgaatcacggccagaggcagcctgggaggagagacccgggcggctttgagcccctgcaggggagtccgcgcgctctctgcggctcccttcctcacggcccggcccgcgctaggtgttctttgtcctcgcacctcctcctcacctttctcgggctctcagagctctccccgcaatcatcagcacctcctctgcactcctcgtggtactcagagccctgatcaagcttcccccaggctagctttcctcttctttccagctcccagggtgcgtttcctctccaacccggggaagttcttccgtggactttgctgactcctctgaccttcctaggcacttgcccggggcttctcaaccctcttttctagagccccagtgcgcgccaccctagcgagcgcagtaagctcataccccgagcatgcaggctctacgttcctttccctgccgctccgggggctcctgctctccagcgcccaggactgtctctatctcagcctgtgctcccttctctctttgctgcgcccaagggcaccgcttccgccactctccggggggtccccaggcgattcctgatgccccctccttgatcccgtttccgcgctttggcacggcacgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgc

SEQ ID NO: 68 - DNA, 984 bp, Homo sapiens
acaaataaaacaccctctagcttcccctagactttgtttaactggccgggtctccagaaggaacgctggggatgggatgggtggagagagggagcggctcaaggactttagtgaggagcaggcgagaaggagcacgttcaggcgtcaagaccgatttctccccctgcttcgggagacttttgaacgctcggagaggcccggcatctcaccactttacttggccgtaggggcctccggcacggcaggaatgagggagggggtccgattggacagtgacggtttggggccgttcggctatgttcagggaccatatggtttggggacagccccagtagttagtaggggacgggtgcgttcgcccagtccccggatgcgtagggaggcccagtggcaggcagctgtcccaagcagcgggtgcgcgtccctgcgcgctgtgtgttcattttgcagagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgc

SEQ ID NO: 69 - DNA, 545 bp, Homo sapiens
aggaggcgcaacgcgctgccagggcggctttatcctgccgccacagggcggggaccagcccggcagccgggtgtccagcgccgctcacgtgcctcgcctggagcttagctctcagactccgaagagggcgactgagacttgggcctgggagttggcttcggggtacccaaggcgacgacagctgagttgtaccacgaagctcaggccgaggcctcctcccttgtctggccttcgaatccatactggcagcctctcctctcaggcactccgcgggccgggccactaggccccctgctcctggagctgcgctatgatccgggtcttgagatgcgcgcgattctctctgaaccggtggagaggaggctctgccccgcgcggagcgaggacagcggcgcccgagcttcccgcgcctctccagggcccaatggcaagaacagcctccgaagtgcgcggatgacaggaaaagatcttcagttcttctgccgctagagaagtgcgggatacaagcctctattggatccacaacctggagtcctgccttcgga

SEQ ID NO: 70 - DNA, 1533 bp, Homo sapiens
atctgcgtgcccttttctgggcgagccctgggagatccagggagaactgggcgctccagatggtgtatgtctgtaccttcacagcaaggcttcccttggatttgaggcttcctattttgtctgggatcggggtttctccttgtcccagtggcagccccgcgttgcgggttccgggcgctgcgcggagcccaaggctgcatggcagtgtgcagcgcccgccagtcgggctggtgggttgtgcactccgtcggcagctgcagaaaggtgggagtgcaggtcttgcctttcctcaccgggcggttggcttccagcaccgaggctgacctatcgtggcaagtttgcggcccccgcagatccccagtggagaaagagggctcttccgatgcgatcgagtgtgcgcctccccgcaaagcaatgcagaccctaaatcactcaaggcctggagctccagtctcaaaggtggcagaaaaggccagacctaactcgagcacctactgccttctgcttgccccgcagagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtgaggccctgccctacccgccccgacctcgggactctgcgggttggggatttagccacttagcctggcagagaggggagggggtggccttgggctgaggggctgggtacagccctaggcggtgggggagggggaacagtggcgggctctgaaacctcacctcggcccattacgcgccctaaaccaggtctccctggattaaagtgctcacaagagaggtcgcaggattaaccaacccgctcccccgccctaatccccccctcgtgcgcctggggacctggcctccttctccgcagggcttgctctcagctggcggccggtccccaagggacactttccgactcggagcacgcggccctggagcaccagctcgcgtgcctcttcacctgcctcttcccggtgtttccgccgccccaggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgt

SEQ ID NO: 71 - DNA, 702 bp, Homo sapiens
aggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctagggcgtgcggtaggcatcgtatggagcccagagactgccgagagcactgcgcactcaccaagtgttaggggtgcccgtgatagaccgccagggaaggggctggttcggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaat

SEQ ID NO: 72 - DNA, 3180 bp, Homo sapiens
gatgtcctgtttctagcagcctccagagccaagctaggcgagaggcgtaggaggcagagagagcgggcgcgggaggccagggtccgcctgggggcctgaggggacttcgtggggtcccgggagtggcctagaaacagggagctgggagggccgggaagagcttgaggctgagcgggggacgaacgggcagcgcaaaggggagatgaacggaatggccgaggagccacgcattcgccttgtgtccgcggacccttgttcccgacaggcgaccaagccaaggccctccggactgacgcggcctgagcagcagcgagtgtgaagtttggcacctccggcggcgagacggcgcgttctggcgcgcggctcctgcgtccggctggtggagctgctgcgccctatgcggcctgccgagggcgccgccgagggcccgcgagctccgtggggtcggggtggggggacccgggagcggacagcgcggcccgaggggcaggggcaggggcgcgcctggcctggggtgtgtctgggccccggctccgggctcttgaaggaccgcgagcaggaggcttgcgcaatcccttggctgagcgtccacggagaaagaaaaagagcaaaagcagagcgagagtggagcgagggatgggggcgggcaaagagccatccgggtctccaccaccgccctgacacgcgacccggctgtctgttggggaccgcacgggggctcgggcgagcaggggagggaggagcctgcgcggggctcgtgttcgcccaggaatcccggagaagctcgaagacggtctggtgttgaacgcacacgtggactccatttcattaccaccttgcagctcttgcgccacggaggctgctgctgcccggcggctgctacccaccgagacccacgtggcccctccccaggggtgtaggggtgacggttgtcttctggtgacagcagaggtgttgggtttgcgactgatctctaacgagcttgaggcgcaaacctaggattccctgagtgttggggtgcggcgggggggcaagcaaggtgggacgacgcctgcctggtttccctgactagttgcggggggtgggggccggctctcaggggccaccagaagctgggtgggtgtacaggaaaatatttttctcctgccgtgtttggctttttcctggcatttttgcccagggcgaagaactgtcgcgcggggcagctccaccgcggagggagaggggtcgcgaggctggcgcgggaagcgctgtaggtggcagtcatccgtccacgccgcacaggccgtctgcgccgtcggaccatcgggaggtctgcagcaactttgtcccggccagtccccttgtccgggaaggggctgagcttcccgacactctaccctccccctcttgaaaatcccctggaaaatctgtttgcaatgggtgtttccgcggcgtccaggtctgggctgccgggggaggccgagcggctgctgcagcctccctgctgccaggggcgtcggactccgcttcgctcactacgcccaggcccctcaggggcccacgctcaggacttcggggccacacagcaggacccggtgccccgacgacgagtttgcgcaggacccgggctgggccagccgcggagctggggaggaaggggcgggggtcggtgcagcggatcttttctgttgctgcctgtgcggcggcaggaagcgtcttgaggctccccaagactacctgaggggccgcccaagcacttcagaagcccaaggagcccccggccacccccgctcctggcctttttgccaacgactttgaaagtgaaatgcacaagcaccagcaattgacttcccttccgtggttatttattttgtctttgtggatggtgggcagatggggagagaggcccctacctaacctcggtggctggtccctagaccacccctgccagccggtgtggggaggagctcaggtccgcgggagagcgaatgggcgccaggaggtgggacagaatcctgggaaggtacagcggacgccctggaagctcccctgatgccccagagggcccttcctgggaaacctcccgggggggtgccccataccatcccacccggctgtcttggcccctcccagggagccgcaggagaaactagccctacacctgggattcccagagccttctgctggggctcctgcccccgacttcggataaccagctccgcacaggtccccgagaagggccgctggcctgcttatttgatactgccccctcccagacaggggctggtcgagcccctggttctgctgccagactgaagccttccagacgccacctcggtttgggcccccagggccctcaggggccccaggagaggagagctgctatctagctcagccacaggctcgctcctggtgggggccaggctgaaggagtggaccctggagaggtcgggaaccttttaacagccgtgggctggagggtggctactaagtgttcggtctgggaagaggcatgacccgcaccatcccggggaaataaacgacttcttaagggaatcttctcgctgagcgggtgctctgggccaggagattgccaccgccagcccacggaacccagatttgggctctgccttgagcgggccgcctgtggcttcccgggtcgctcccccgactcagaaagctctcaagttggtatcgttttcccggccctcggaggtggattgcagatcaccgagaggggatttaccagtaaccactacagaatctacccgggctttaacaagcgctcatttctctcccttgtccttagaaaaacttcgcgctggcgttgatcatatcgtacttgtagcggcagcttaggggcagcggaactggtggggttgtgcgtgcagggggaggctgtgagggagccctgcactccgcccctccacccttctggaggagtggctttgtttctaagggtgcccccccaacccccgggtccccacttcaatgtttctgctctttgtcccaccgcccgtgaaagctcggctttcatttggtcggcgaagcctccgacgcccccgagtcccaccctagcgggccgcgcggcactgcagccgggggttcctgcggactggcccgacagggtgcgcggacggggacgcgggccccgagcaccgcgacgccagggtcctttggcagggcccaagcacccct

SEQ ID NO: 73 - DNA, 1038 bp, Homo sapiens
tggcggccggcgggcacagccggctcattgttctgcactacaaccactcgggccggctggccgggcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttc

SEQ ID NO: 74 - DNA, 1200 bp, Homo sapiens
gtcctaacatcccaggtggcggcgcgctggctccctggagcggggcgggacgcggccgcgcggactcacgtgcacaaccgcgcgggacggggccacgcggactcacgtgcacaaccgcgggaccccagcgccagcgggaccccagcgccagcgggaccccagcgccagcgggaccccagcgccagcgggaccccagcgccagcgggaccccagcgccagcgggaccccagcgccagcgggtctgtggcccagtggagcgagtggagcgctggcgacctgagcggagactgcgccctggacgccccagcctagacgtcaagttacagcccgcgcagcagcagcaaaggggaaggggcaggagccgggcacagttggatccggaggtcgtgacccaggggaaagcgtgggcggtcgacccagggcagctgcggcggcgaggcaggtgggctccttgctccctggagccgcccctccccacacctgccctcggcgcccccagcagttttcaccttggccctccgcggtcactgcgggattcggcgttgccgccagcccagtggggagtgaattagcgccctccttcgtcctcggcccttccgacggcacgaggaactcctgtcctgccccacagaccttcggcctccgccgagtgcggtactggagcctgccccgccagggccctggaatcagagaaagtcgctctttggccacctgaagcgtcggatccctacagtgcctcccagcctgggcgggagcggcggctgcgtcgctgaaggttggggtccttggtgcgaaagggaggcagctgcagcctcagccccaccccagaagcggccttcgcatcgctgcggtgggcgttctcgggcttcgacttcgccagcgccgcggggcagaggcacctggagctcgcagggcccagacctgggttggaaaagcttcgctgactgcaggcaagcgtccgggaggggcggccaggcgaagccccggcgctttaccacacacttccgggtcccatgccagttgcatccgcggtattgggcaggaaatggcagggctgaggccgaccctaggagtataagggagccctccatttcctgcccacatttgtcacctccagttttgcaacctatcccagacacacagaaagcaagcaggactggtggggagacggagcttaacaggaatattttccagcagtga

SEQ ID NO: 75 - DNA, 900 bp, Homo sapiens
caccttccccgaggtaattattttctggggggtaggggtgggggttgggagggtgaagaaaggaagaaaaagaaggccgatcacactgggcaccggcggaggaagcgtggagtccattgatctaggtacttgtggggaggggagaacccgagcagcagctgcaaacggaagggctgtgagcgagcgggcgggcgggtggctggcagcgaggccaccagcagggggggcccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggtgcgcggggtcgggtctgggtccagggagcgggtcgggaagtctgcggcacggagcactgctagtgtcggatctgcatctccagctctgtgctgcagcttcacttgcccgccccccaccactggcttctcacccggggtctctgccaaactctggctgctgccgccctgggttcgggccggcggaaggccctgggcgtgcgctgcggagccgcctgcgaggactccactagggcgctttccaggctggactgccccgggctgcgctggagctgccagtgctcggggagtcttcctggagtccccagctgccctctccacc

SEQ ID NO: 76 - DNA, 200 bp, Homo sapiens
ctcttcccaagttacgccaccggtcgaggacggcaggagacccccgagtgcagagaaagctcaaaccggcagcgaagtcggtcctagccaagctgaaaaaacgtctcggatttcgcggacagcggcctagacacagcccgatcttccagtcctagtgccctggtcgagacggttctatccttttgcaaagaagccggaaa

SEQ ID NO: 77 - DNA, 400 bp, Homo sapiens
tctcggttgcaatccccaccctcctcacccagcagggcaggaggcacccaacttggaggagaaaggggtgggggaggtgaaacagagaccggagagtcacgagggctgggccgccgagagcaggagaatataccgtgtcacacacctccattctctcacacacgttgcagacacaaatcactgacggtttccacgtgctgcgctcgtgagcggaggtgttcaaagagggggcagatgagttacttcccgagacggaaccgggggtcccacgtccgccgccttcagtagcacaaccaatctctgaacactcaaaccgcgcatctctggcgcatcaccatcctatttaaggccacgggctccgcccttttcctcccctcccttcttttccactctttttcca

SEQ ID NO: 78 - DNA, 700 bp, Homo sapiens
ctgccagagatgtgtctgtcttgcgccccgcatgcactgcctgcggggctgcgctgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctcgagccgctgggttttcgcaagccttggggcctctggccgcccttccatgcctccgggcgcgggcggctcagcaggtccccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtagggg

SEQ ID NO: 79 - DNA, 200 bp, Homo sapiens
aggggtgtcctccaacatctctgaaccgccttcccttcctcctcactggcgccctcttgcctcagtcgtcggagatggagaggcggctgaagattggcaggcggcggccagggtcgaggctgggagactcagagccgctgaggctgccggagctcagggagccgcttaggtagctgtcgcggtccgacagcgagtccggg

SEQ ID NO: 80 - DNA, 5000 bp, Homo sapiens
tctgactctcgggctggagcagccgagacagcgctccccagcgggactacagaatcccgggtgtcggcctgggggccctggattggcagtggtggagtcttctgagcctaacagctactaggaatgacagagttgcagatggctttgtcgcccgcggggcggctcaagcgtcctgggtcccaggcctctgtcctacggccaggccgccggctcaacgggccgaagggaatcgggctgaccagtcctaaggtcccacgctcccctgacctcagggcccagagcctcgcattaccccgagcagtgcgttggttactctccctggaaagccgcccccgccggggcaagtgggagttgctgcactgcggtctttggaggcctaggtcgcccagagtaggcggagccctgtatccctcctggagccggcctgcggtgaggtcggtacccagtacttagggagggaggacgcgcttggtgctcagggtaggctgggccgctgctagctcttgatttagtctcatgtccgcctttgtgccggcctctccgatttgtgggtccttccaagaaagagtcctctagggcagctagggtcgtctcttgggtctggcgaggcggcaggccttcttcggacctatccccagaggtgtaacggagactttctccactgcagggcggcctggggcgggcatctgccaggcgagggagctgccctgccgccgagattgtggggaaacggcgtggaagacaccccatcggagggcacccaatctgcctctgcactcgattccatcctgcaacccaggagaaaccatttccgagttccagccgcagaggcacccgcggagttgccaaaagagactcccgcgaggtcgctcggaaccttgaccctgacacctggacgcgaggtctttcaggaccagtctcggctcggtagcctggtccccgaccaccgcgaccaggagttccttcttcccttcctgctcaccagccggccgccggcagcggctccaggaaggagcaccaacccgcgctgggggcggaggttcaggcggcaggaatggagaggctgatcctcctctagccccggcgcattcacttaggtgcgggagccctgaggttcagcctgactttcccgactccgccgggcgcttggtgggctcctgggcttctgggctcacccttacacctgtgtactaaagggctgctaccctcccgaggtgtacgtccgccgcctcggcgctcatcggggtgttttttcaccctctcgcggtgcacgctttttctctcacgtcagctcacatctttcagtacacagccactgggtctccctgcccctccagcctttcctaggcagctttgagggcccagacgactgaagtcttactgctaggatgggaacacgatgaaaaaggaaggggcccagtcaaaagtcctctcctcttcggtttttcttcaactgtccttcacaaaaacatttatttctgtcccagcgccctggcggatttcggcagatgggccctagggggttgtggaggccaaattcccaggatgctggtcctgcctttttcattggccaaaactgtatttcctacaacgactaaagataaccaagaactgagtagaccctgttctctcaccagatctccctggctctgtttaacttttcctggtgcaatgcgatggcaccaccagctccccaggcaggcaccactccctcaagataccatttggggtagggatttgagtcctggagagggtcagcggggcgccggggtgggggtgggaaggagactgacagggacacaccgcgagctccgcatactctcctctgccccctgtagcccggggctttaatgaccccaagcagatttcctgtctctggtctagccagctgcccctagggctggattttatttcttcatggggtttcaccctaaagggccccctggtcatgggacctggttgggaacaaatgaaagatgtcttgtagcaaatgctttcaggggagcagaaaagaagattgggcacttccagtcacttggtcactttaggtggctggaacaaaactggtgactttcacgactgctacagggtgagggggtgaagggtggcagagaggtgacaagccactgggaatcctattcagtggggatgccgacagggagtggctgtaatcaactgagcaacatctgtgtgaatgttattcacaggtcaggacagcagcttggtcttcccaggtgaggaactgaggactggcctgcatagatttgtgcagtaggtgagtagcttccaaatttattttcagaacttccatgtagtacctgcctctccatttaaatattttttaaaattttatttatttaaatattttcttggttagctttccaagagggaggaaaagaggggagttgcaacaagtagtgcccctatgctgggattcattttccagagtaaagcctgggactggcaccctgacccctaccggcaggtgaaaactccaggcaaactgctgagatcccacctgggctggctgagatagtgcctggggtgcatccctcagcagctgccacctgggccctggggccatctctttctctggcatcaagcagccaggtgtcaaggccttcccagcaatccatgctgcatggctgggtcttgttctagcaggtcgatgggcagggactggtagcttagccagggcaccagtgcgtggctgtgggtttgtgtgcttctgtggagaagcatgatgtgtatgtgtgtgtgtgggcacaggcatgaggaagggttcatttgtgcaggtatctcccatgtatatcagtgtgggagagtgcctgaggatgtgtttgtgtgtctgaaaatgggcggagggtctgttgtgctaatgtgtgcaggggtgaacatgtgtgtgacagtctgtgtgtttccctgagtggtggctgcgtgagagggtgaggggatttggtgttgtctaccatgcccggcacatagcaggctcttaataatcttgaatttaattaatgttaaatgtgtatgttcccatccttgtggaagttggtatagagcctgttttcctgtgattgtgagactggaaaatgggggacgggcaggggcgagacaggatacagaggctactgttttcttcctccctagaagtaagtacatagaagagtgggctctggcacctcacgggacatcaccaagtcctgtgtggctggctaggctgtcccaaggtggcttcaggcatcacttgaatcttttgagaccttcaggcagtagcctgccattcaccctgtcagtcagcagaagttgggcccacacaggccatagaaacacagagcagttcccgggaggacctgagctgtccctgagagcagagcttccaggagaggccgcaggaactgccttgaccggaattcctcttggggtgcaaaggtggagggacacatggtgcgaccccaggcagaggactgcagccactccgtgcagtcccagcctctggggtagccccttgacctccaggcctgcacagatccaaggccgaggtccaggctccagcgccaaattagctggcctagcagcctgcagccgctctaatctcaactaggaaggaatccttgcgcttagaaagtccaagcgaaagggtattctgattttatcccggttttaccagaaaatgctgaaaggaaaagccccgagaggacacagtgctctaggaactcggggcgccacgagcgcctcatcccctcccttccgcccggccgcggtgccctggtcgctgagggacgcggtcagtacctaccgccactgcgacccgagaagggaaagcctcaacttcttcctctcggagtcctgcccactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactccgggaaagcgagggccgaggtaggggcagatagatcaccagacaggcggagaaggacaggagtacagatggagggaccaggacacagaatgcaaaagactggcaggtgagaagaagggagaaacagagggagagagaaagggagaaacagagcagaggcggccgccggcccggccgccctgagtccgatttccctccttccctgacccttcagtttcactgcaaatccacagaagcaggtttgcgagctcgaatacctttgctccactgccacacgcagcaccgggactgggcgtctggagcttaagtctgggggtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtacccgccctcggcacaagctctctcgtcttccacttcgacctcgaggtggagaaagaggctggcaagggctgtgcgcgtcgctggtgtggggagggcagcaggctgcccctccccgcttctgcagcgagttttcccagccaggaaaagggagggagctgtttcaggaatttcagtgccttcacctagcgactgacacaagtcgtgtgtataggaaggcgtctggctgtttcgggactcaccagagagcatcgccaaccagaacggcccacccggggtgtcgagtcttggtagggaaatcagacacagctgcactcccggcccgcgggccttgtggcatataaccatttatatatttatgatttctaattttattataaaataaaagcagaaatatttcccgaagaacattcacatgagggcattacggggagacggcaagtcggcggctcggggggcgcgctcagccgggagcgctgtagtcacagtcccgggaggaagagcgcg

SEQ ID NO: 81 - DNA, 1500 bp, Homo sapiens
tggaacaagtgtcagagagtaagcaaacgactttctgagctgtgactctgctcctcgactgcccacgtgctctccgctgtctgcactcctgcctcacctgggctgactcggactctccacctcctttgctgcttccggcatgagctacccaggagcctaaggcgctccttcccgcaactccggtccccgcgccccgggactgcaaatcctttaaacagaggccccagagctaggggttttcccaggctctggtgggcgtgggctgacagtcgctgggagccccgcaacaggggggatgtccaggcaggtatgcacccagctcccggcgtttcccggagtcaccacaatgtttccctttctctctcccccacgtatgctgctaggggtactccccagataggattttctttgtcttttctcctagtaacaccgaagccctctcgtgcccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccccgaagcttcaaagttgcggcaaacagttgcggggagcagaggaactgaggtccaggccagcgcgcccgcggtcgctcgccttggggagcaggctgagccgagggtcgtgcgggtgcgcggcagaggcggtaggaggcggaggagaggggggagaaagagggggcggtggggaacagctgccggggtaggcgaggcgcaaggtggctccccgcggccccgcgccccgcggctctcggacgcaccaggcagccaatggctgcgcagaggtgtacagcagatggcgtctgactgcgccgttccttcctcctcctcctcctcctccttctcttcctcctcctccttctcttcctcctcctcctccttcagtgctgaggagccagagtcgccgccgggttgccagacgctggaatgggtggtcttccgacacacaccaccatctttcttgcgctcgggaagctcggggctcagcggctcccagaggttacggcggcggctctggcgagacgggtgagtgcaagcacgcggagccccgagtcggggatgccgggccccctggccggccgactggggcgcggggtggcagcgccggggaagggggcgcgctgccggcgcagactttgctctttcctcgccggacagccatcgtcgccccttctcccagccagacgcgggaacttggaagcggatcttctcggacgcctctggcttggggctgcgggaagcgtgggctgcccggggcgcagtgtgcggagaccctctaggcgggcggggacgccccac

SEQ ID NO: 82 - DNA, 800 bp, Homo sapiens
gttattatccacggggtcctaattaaagcttgattaaaatgcccttctttctctaaaaaattacgaactaggcaacttcatacattttgaatggcgcagtgtttcctcttccaactgtttagtttgtagtatactatgtaagcaacatcaattatcaacccttgcaagatgacaacatgagcctgtgggggaagcacttgaggggagggaggagaaacttctcttttttaataatcagccggaaacaatgtttaacaagaatctgatgaggtcactgcagtaaatatttttcctcttacagagccaatcatcacggagggatcccctgaatttaaagtcctggaggatgcatggactgtggtctccctagacaatcaaaggtgtttgctttctgctctgttgcttttaaattgtatgggaaaggaagattggtccgacggcgcgcttgtggcccggccggagcttgcgtgcgcgttctgacggctgggtgctgtgttacaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggc

SEQ ID NO: 83 - DNA, 40 bp, Homo sapiens
tccctgctgtgggacccgaggagaggagaactggttcgct

SEQ ID NO: 84 - DNA, 500 bp, Homo sapiens
tctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtgagtacaacctgctccctccccgggcacagatatgacagaggggcttagagggggcccagctttgagatgggttgttcttatgtcacaggacagagtgatctgacatgcacacttccccgccaccctgtcat

SEQ ID NO: 85 - DNA, 500 bp, Homo sapiens
tgtcctcgaagaagggcctgagcagcagcagaggaccccaggcgaccgtgcctgagccgggcgccgacgacgactgagcacctgatatgtccccggcactcgcagccccgcggccggagtcgctgtgggtgagcggtcgtcgagcttcacagaggccgggctctgtgccagggccccgacagggcaggaagcagatagagtcccacaagcacaagcccagtgcgcagaaagggttacttaaaaaataagttctgtgataaaatcaaacagggtgaagggctggaaacaggtcatgagggcgcaaacaggtcgtgagggcgcaaacaggtcgtgagggcgcaaacaggtcgtgagggcgcaaacaggtcgtgagggcgcaaacaggtcgtgagggcgcaaacagatcgtgagggcgcaaacaggtcgtgagggcgcaaacaggtcgtgagggtgcaaacaggtcgtgagggcgcaaacaggtcgtgagggtgcaaacaggt

SEQ ID NO: 86 - DNA, 300 bp, Homo sapiens
aaatgagacctctggggagactgtcaaccccaggggtaaaacaaaaattctgatcagaaactgagtttcccaaagaaggggctaaatgttttccaacactttcggggctcagggaagatgactctgtaaggacactgagaatcttcctcgcgtgccacggggaggaggactgggggcgtttgaggggctcagcgcaccagaggagtgaggtggaggagggcgttcccgcgtcctcctcttcaatccagagcagctcaacgacgtggctccctttctatgtatccctcaaagccttcgcgt

SEQ ID NO: 87 - DNA, 600 bp, Homo sapiens
taggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctaca

SEQ ID NO: 88 - DNA, 800 bp, Homo sapiens
gaggttgctgactcaggagccaggagctgagaaactcctaggctagcagccgttgagcctaattttattttctggctttctccgaaatgtctcgtttccctcatctttctggtccttttcgtctctcttattttccccaaaacgtctacctcacttcgtcttcctttctcctcccctccccctctctttcctctatactctcttcccatttagccttgcaggcccctcctccccggtgttggagagctcaaagacgcgcgaaactcaaggatctggccctgaccagggacgggattaggcgggaagtggtgacggcctgaaaaggctgggctcgaacccgtgccttcctgaaaggactctccccgccacaagtcacacccacccgcaggcctgctggccaaagaaacaaaggagtcgggcgtggatccaggagaaacaggttttcgctctcggatctccctgggcaaatcagggatcctgagcgctataccccgcagtcgtacggagcctctgggaaaggggatttaagggtgacttccactttcagcttcggctacttgttgcctgcggtccaagccttctctgcttcctcctacctcgtcttaggcctctgtagaaagtgcacgccgcgtttccccttccaggctctgagagggcctgcaggcccgtggccgcctccgacaagatgccttccagtgctaggggggccactttggcgggatgggggtcggttggttaaaaaaaacttaagttctggctcagtcgagtgtggcaaaagccgagggtcgggggttgggggg

SEQ ID NO: 89 - DNA, 2000 bp, Homo sapiens
tactgacctggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctca

SEQ ID NO: 90 - DNA, 800 bp, Homo sapiens
gggggacacagagaggaggggttgcgggcctgtgagaatgaagagcacagagcggagagggggaggaggagggaaaggaaggcgtggcagtgagagagaagaggaagaagagaggaggagtggggaggggagggagagcaagacagcagcgggtctggattcccctccgagccacatctggtcaggttctaagtaattagaagattttcccattggtttacccaagggctctctctctgattaattttcgaaagagttggccaattttaatcatagcaaacacgatgatcacggtgatcatggcctgaacagctaaaagcagaaaataaaacccccagaacggactatgatcttgacctttgcccgtggtcaccggctgggcccacacccagggttctgagctgttgggagccaaggctgggtggacaggggcttccgaggagctgtccgcagcggggcggggaggcgggccccgggggcccgggcactccgcgtcaccccccggcagggcccagagcggcaggccggcgtgcgccccagggcctgcgcaccgtgggggctcttccccgcccacgaggcctaggtgctgccgcagccaccccaggaagggccccaggccacagtcgcagcgccaggagttgtgccccaacaggacctccgtcagccggggcagagccccaaacacgtcgccaggcagggtctccagctggttgtggtcgagctggacgctctccaggctgctgagattgcggaagagggcacggggcagggcgcgcagcctgttgcggcgcagggacacc

SEQ ID NO: 91 - DNA, 550 bp, Homo sapiens
gccccggtgcaccgcgcgtccagccggcccaactcgagctagaagccccaaccactgcccagtgcctgagttgcagtcttgggtcctttagaaacctggagatgtgcgtaaaattcagatgccggtattcccgaacttccccaggcctcagcatatctcggcggcctgtggacagatgggaggctaccaatcgctccggcgtccgcagcccgacccctgccgccagaccccggacgtcttccggataataaagttcccgctctaattcattttccctaatctggacgcccctaatctacagcttttattgcgcccagttaaaagtcgagggaattcgctgtccctccgcgctcggataattacccctaaatggccacggcagccccttgtgtttcctggagattagaaccccgcagtcatcaatggcagggccgagtgagccgccaatcacctccgctcactccctgagagccgctggcctgggccgcaggaggagaggccataaagcgacaggcgcagaaaatggccaagccccgaccccgcttcaggc

SEQ ID NO: 92 - DNA, 2000 bp, Homo sapiens
agggtgcctctgttcaaattagaaaaaggcgccccctcagggcagactcagcccagctgccaggggacaagtcctggctaacgggagctggagctgggtttcacctccaggtgcctccttggcggggcgccccgtgcaggctacagcctacagctgtcagcgccggtccggagccggagcgcgggaatcactcgctgcctcagcccaagcgggttcactgggtgcctgcggcagctgcgcaggtggagagcgcccagcctgggaggcagtagtacgggtaatagtaggagggctgcagtggcagaagcgagggtggccgcagcacttcgccgggcaggtattgtctctggtcgtcgcgcaccagcacctttacggccaccttcttggcggcgggcgccgaggccagcaggtcggctgccatctgccggcgctttgtcttgtagcgacggttctggaaccagattttcacctgcgtctcggtgagcttcagcgacgcggccaggtctgcgcgctcgggcccggacaggtagcgctggtggttaaagcggcgctccagctcgaagacctgcgcgtgggagaaagcggcccgcgagcgcttcttgcgtggcttgggcgccgccggctcctcctcctcctccgcgacgcctgccggcccgctgccgcccccgccgccggccccgctgcacagcgcggacacgtgtgcacctctggggccaacaccgtcgtcctcggtccttgggctgcggtcgcctgcggaccccggtgggaacagaaacaagagactgtcagcgccacagacgaggtgaggccgggcctcaactgcaggggtcacgggagtggggcggaaatacactttgatcccactcaagcggagcggaggtctgggaggccctgggcccgggagaccagtcttagactcttgccccactgggtatcccatctaggcctcttctggggagggcggcagactcagccgctgtgtcaacgctgtgttgtcgagaccagctccccaccctctctgggccccaggctcccctcagtaacttggggcactcgacccgagcatccgcgaaagccctcccggctctcagcgttgagcattgggattctagactgcatttccgtctctctgcttgggttcacgcgcctctccacacttagttcacacgcacacacgcgcgcgtcctcgcagcacacacttgtctggtgcaggtaagggaaggtggaggcggatcctggggccaaaggtatttagaatctttcaccctcagccgcctgggattgctgtgagagacatggaaacaggctgagccgaggccttagatgagaggatggactggagagtaaagagggagggttgcccctgcatcgagtttttggaccctgatcccacaccagcttctcggtctcgtacccgcccttccgaagaactccagcagaaaggtccagcggtcccctgtgcttgaggcctacagaagcttgtacccaactagggcaggcacccgggtcttccagaccacaggacaggacaggccacggctgaggaggcctctctcctgcctccaggatgaactaaagacccaatccgggatcttcggcctagggctgctctcccagacctggggtctgagaaagccaaaccagccctttccccaaagctctagttctgcagattctcagctctggcccactcggaggtgttcttcaccacctatccacctactgtggggcccggccctgggaccttgaactggcaggtctctggtccagagctaggtcactggctacctgaggtctctgaacccctcacttttccgcttccctgattttggggatttggggacagacacggcagaaagcactggcgacgaactcaaaaactcccgaacgcaaggggcagcggttctcccaacccagtctaatgcacattggcccaggatgtctcaggcctcaccccaggacgtagggctctgaggagctactccggtctctcgcgggct

SEQ ID NO: 93 - DNA, 1000 bp, Homo sapiens
gagaagggatgtggcggggggctcctccggccctggactccctgggtggactagaaaagggcaaagaagtggtcacatctgtgggccagactggtgcgcgatctttggaggcgcagcagcaaggccgcgccagggctgagcccagaccgcccacgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgcctctgaaaataccgtcagggtaaagggagacaggcagtaagtcttaccaccaccgccctttccccatgtcattggccaaaaactgaacattaagataaagcagctgtttcagtcaatggaaagcggtagggcgaggttgtacccaaaacccggtttagacggccaatgaagtcctaggaaaagccgccccgggggcacgttcaggtggagcggctgcacctcgggtcgttctaagggatgggctgcgtggtacccacggaattcatgggtccaaaaggtcctggtcacctgtccaaacatccatcccctggcgcatggcggttgacaagatggcccggccacccagaggaaggaggatccgggacggggaacttcgcgccgggaagctgtagcccagagctgcagctcagcattcgcaagagattcatcttttttttctctcgtgttcggagaaacagataaacaagacaccgcctcatcagataagaacgtctccttcgatgtcacggatttcaagaggtagctggagaaactgacgtca

SEQ ID NO: 94 - DNA, 1300 bp, Homo sapiens
caggtcaggcagaacttctgcccttcccgctactggcaccccaagcagggatgcactgggatgcgtggcaggggcgggatctcctgggagcgtctcagcccagcagggagtggggaagcaagagggaaggcttaccttcctcggtggctggcaggaggtggtcgctgctagcgagggggatgcaaaggtcgttgtcctgggggaaacggtcgcactcaagcatgtcgggccaggggaagccgaaggcggacatgaccggggcgcagcggtccttcacctgcacgcagagcgagtggcatggctggatggtctcgtctaggtcatcgaggcagacgggggcgaagagcgagcacaggaacttcttggtgtccgggtggcactgcttcatgaccagcgggatccaagcgccggcctgctccagcacctccttcatggtctcgtggcccagcaggttgggcagccgcatgttctggtattcgatgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcgggctgcgggagtggggggcacgcagggcaccccgcgagcggcctcgcgaccaggtactggcgggaacgcgcctagccccgcgtgccgccggggcccgggcttgttttgccccagtccgaagtttctgctgggttgccaggcatgagtg

SEQ ID NO: 95 - DNA, 500 bp, Homo sapiens
tgcgatcattaaaatcagttccttccctcctgtcctgagggtaggggcgggcagattttattacttctcttttcctgatagcagaactgaggcggggttgtggaggagcgacggaggaccacctctaacttcccttcacttcctggatttgaagcctcagggccaccggcctcagtcctgttacggtggcggactcgcgaggttttccagcagctcattccgggacggcggtgtctagtccagtccagggtaactgggctctctgagagtccgacctccatcggtctgggagcgagtggttcgagttcagatgctgggaaccgtcgcttctccccggccgggctcgctgttttctcctccgctcgccgtcatcaagcccggctatgagcagggctttaaatcctccctccctcacccgcaggtttaccgagcagccccggagctctcagacatgctgcgctgcggcggccagaggaggggtgggggcattgccctctgca

SEQ ID NO: 96 - DNA, 500 bp, Homo sapiens
gggcttgggccgcaggcttccctggacttccgcagtcccccttctccccattccagaacctgccgagcccctgctgcatctgggacccgccttcaccgtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctatta

SEQ ID NO: 97 - DNA, 600 bp, Homo sapiens
ttctggggcctggatgggtgcgagcgggacccgggggagtgggagtcgccaggctctgagcaagcaagggctgcacctgcacctctgccgggcatgaagaaaggtaaggaaggaaggagctcacccgggtgggagacagagccggggcgcgcgagcttggtgtgggggcgccactccggggcggaggggaggggctaccagtgacttctccgagtcgggagctagaaagaggcttccggccaggttcccttggaacaggtgtcggagttgttgggagagggggctgcaagaaagaggggtgcagaaactggttcattagatggaggctctgggcggaaccgcgaggacaccctggcagcgcgctgtgcctgcgttaggccgggaggggagaggcctccggacggcgaagtgtccctagggacccagacgcctcgggagcgatccgggccgctgcgaagccctgcccaccaggagtggatccccaggattcacctcccggctgcctgctctgagctgagaaggggatctggttcttcacaataccgtggatggcggggaaggggagggagcctggggtaaaatcccatcttggtttcctcg

SEQ ID NO: 98 - DNA, 1300 bp, Homo sapiens
tgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccaggcgcaactgggcgcaactggggcagctgcgacaccgaatccctcacatctgcaacctgggtgctgcggccactgagaaaatggaggcgcagaccaacgagcggtgccgcgaccgagagacctcggctggcgaaatggtggtgccgggagcctgcgagtgacgccagccggcggggttgtcaaggacaacattcgttttgacgcagccaatggcgccgtcaccaagaaaccatcgactctgagaaaaaagagaggttcggccaccgagaaactccgtacgacaagtgctgtggcagaaaaaccgcctactccgcgccacaggcaaaacagccaatggaaaccccaggtgctgcgaccgtgacaccggcactagagggtctcggatggagaaagcggcgcacggagaccaggaaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgccggactcagtgaaaccagccttgcctccagcggattccccggcttcgccggacgccacaggcagagtgccgcggggaaacctctggctccctaaaccgattagattgtgggagtgggggggacactcacaagttgtgtggaagggaaccagcggcaatgggacccggcgagcacttgcccgcagcaaatgcctgcgctgctgcaaaaaaaacaacttttggcgcaaagaatgttgcggccagagagcatccgctgtcgctgacaaaggagtagcaatggcaatgagaaaccgccggcgccacggccgaccgcggcggctcacgcctatgat

SEQ ID NO: 99 - DNA, 2100 bp, Homo sapiens
caaacgctgagagacaaaaagacaccaacacccaccaggactgcgtcctgccagctcttcactccgctgacctgaccttccacgcccctagtcctcgagcggacttgacctgtgggggagtaccgaaccgtccccatgaggccctccaagcggccaggtggcctccgccactctctccacccccacctcctccaccccccagcccatcggtccatcttcgatctgcaaaacacgccgggtcagcgacgcatcggtcccaggcttgtgaccacctctttctctgttacttggggagccaggcccaccgctcaggatcacagtgaggagaaaaaagacacaaacgccaggacagggcggctggggaaggaaactgctagggaccgctcattgtcagcctggcgtgtcccacggatcgcaggacccgtcgaggctttgctctctgcgacccgaatactcctgggcctctcgacctcctcctcggactcaggcgtccgcgtctccggtcatcacgggagaccaattggtttacaaatagtgatgataaacctgggaccgaccttggggctgtgtaaaagtctactgacagatgtaatggagggttgttagcagtcacaaagcctgtcggacccgtagcattagttcaagagactattttcgtgtcgcaccaaaattactgcgcgtgtaaaccaatttccccgacggaagaataaacagagattcgtttgaagcgcgagatgaaaacagatggggtatcgcaaacagttccccaaaatacaacagacttctgggccaattacacgtggttagctctgaatggcagaggaaatagttttctttgctgctaaatgtcacaaaagtcacctaaaggcacagaggaggccgctctgtttttgcgaaacttgctaaaattaatctgcgctgggccacttgcagaaagcagaaccacctcccgcccccacctcgcctccagccgccggggttcaggcgtttgtgaaagacagaacctttgggctagggacccgggcactggtgcttcgaagtccgaatccgccggccgagaaaacgacaagagaaagaaaatccagcgggcgctctctccagcgccaggccggtgtaggagggcgctggggctcggcctgccacccctacccgacattgggaagcagcccctgcgctcccgcggcgcctcagcctccggtccccgccccgaggtgcgcgttcctcctcccgcatgcccgtctcgggccccacggagcaagaagatagacgatgacgaggcgcgcccatccatccgggccgacgaggtcaggcccgcgccacaggcaaaaattgcgcaagcccggccgcagggatttcgcgggcgcctgggtcccaggtgcgcggccgaaatcctcagggaaaatcccgaggggccaacggtctaggccacagggctgctgggcccgggcctggctcagagcgcattcgggcggggaggccgcacgccgcacccgggcctctcctccgagcccgaggcaggcactgagctccgggccagccaggtgcctcccggctggtgcgagaccccgggcctgctgggaggcgtgggcagggcagggcagggctgaaccccagcgactgaatctcgaaggcaggaggcctcggaggtcatcggcccagctcgcctgaaactgtccctgctcgtgccagggcgcgggcagaggagaaaggacagggcggagcaagcccactgcagaactgcggtcggtggctgcgaagggtccgggtcaccgcgctcccggacgccggaagccgcgctggcggggccgcggggagggaggctgggtaccggggccgtccggccggaggaagcggctccggccgcgctgtccgcgcttgggagccgcgtgcagggttcagccgtgtttcagttgccctctgacctgaccccgggcgcacaaaggcctcccgggtgcgccgccatggcccagtcttccagtcgctgccaaattaatgagcccacgtcaggttgggtttacagctcggccgggaagcagccgagtggaaaatgagctcggggccgctccagaggctcccgcacaactgcagaggctgcccgcg

SEQ ID NO: 100 - DNA, 250 bp, Homo sapiens
tttccaagacagaaggagggaactaggcgccttttttccactccgctgaccccaacgtctgggctgtgcgttgtaacgcagttggcggggccttcagcttgggatgagggcgaaggggctcgggatgggtgggaaagcaaggaccgggcaacaggtggggaggtggcggacttttgtctcggggaaggaaatcggctgtgctgaaagggcggaaagcagtagcgcacagaactagtgtctgcggggtccc

SEQ ID NO: 101 - DNA, 250 bp, Homo sapiens
ccctcctgtggctgcttgggcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatg

SEQ ID NO: 102 - DNA, 2000 bp, Homo sapiens
tcctcctttgtgtatgtcaacccagaggatggacggatctttgcccagcgtacctttgactatgaattgctgcagatgctgcagattgtggtgggggttcgagactccggctctcccccattgcatgccaacacatctctgcatgtgtttgtcctagacgagaatgataatgccccagctgtgctgcacccacggccagactgggaacactcagccccccagcgtctccctcgctctgctcctcctggctccttggtcaccaaggtgacagccgtggatgctgatgcaggccacaatgcgtggctctcctactcactgttgccacagtccacagccccaggactgttcctcgtgtctacacacactggtgaggtgcgcacagcccgggccttactggaggatgactctgacacccagcaggtggtggtcctggtgagggacaatggtgacccttcactctcctccacagccacagtgctgctggttctggaggatgaggaccctgaggaaatgcccaaatccagtgacttcctcatacaccctcctgagcgttcagaccttaccctttacctcattgtggctctagcgaccgtcagtctcttatccctagtcaccttcacctttctgtcagcgaagtgccttcagggaaacgcagacggggacgggggtggagggcagtgctgcaggcgccaggactcaccctccccggacttctataagcagtccagccccaacctgcaggtgagctcggacggcacgctcaagtacatggaggtgacgctgcggcccacagactcgcagagccactgctacaggacgtgcttttcaccggcctcggacggcagtgacttcacttttctaagacccctcagcgttcagcagcccacagctctggcgctggagcctgacgccatccggtcccgctctaatacgctgcgggagcggagccaggtgaggggctcggcgccgccccgggcgacccctgggggcggcactggagaagccgcccgtcctcataagggattgaacttgcatccactcctctccggccggcttggtcgctggctgcgctccacccgattctcgggatcattggaccgtttgcgcgaaaccagagtggccgattaagggatggggctccgagcaccgggggtggtggcgactgtgggcgaggggaggtgggaccgacccccacccctacactcaaaaaaggccggggcctccttcgagcttccggtgaatttcgggcgatttccgcgggtgtcgggggtcccgggaggaggcagtcacagatccacccctgcagccagcctcctaggcgccggctccggcacgcttcgccggtctgtagatttcctcttcgatttctccccagctcccagcatctgtgacttcactgttaccctccctatccccgcatcacccaaccgcacctgtctgcgggacttaggtgtgcgcgcggggctcatgcgtgtcctccctgctggccacccccacggcccacacaagttgcacgggctcgccacgccccgccaacacgtgcgcggacgcacgcacgcactcctcgcacgtgggcttacgcgaataccagctttcactgccactcgctcgcggccagattcacaggcctgttccggtccactcgcagctcccctctgccgctccctccgccgggctcaggagtactcgtagctgattgtgcgcgcctgagggtcccagatcgcggccgcccaggaccaggcgaggactccggagcctcctctcacctctcccacctgcgccccgggctgggccgggtcgcctggggggcggcctgagcgaggcgcggggccaggagcgctggagcgactgccgctctaagtgccgggcgggcaggactctacgatccttgggccagaggtccggatggtcccgggactccgtctcaagggtcggcgacccctcaacccagaagcctcgagcaggcggacaggcagagctgcccagtggccgaggcgcgg

SEQ ID NO: 103 - DNA, 1100 bp, Homo sapiens
atttgtcgttgtgccattgctgccactgttgttcttgtccagggaaacaccggtggccaacccagatcggatacaatggtgcggctctggactgagcctccaaccacattagccatgggcagcattgttgctgccgctgctgttattttaattatgattgtacgttaaccaccaccttccttcctctgcctcccttcagctgcaatgatgtatgttactttttggtaactggatttcattaacatttatgaactctcataaagtagtagaaaaagcaatttgtgtggaagaattttccacctcattaaacagtgttcttttgggggtcaagctgatattttttttgttgttagattttttttataggtcctttgtccttccctaagccctgggggatgaaaggagagccgtccacccagcgaggggcttgtgtgccctagagggcgctgggccccgcgcgctttcctggctgtccccgccggctttccaccctccccaaagcccaggtgcccaccgtgggtcgctgcggcctttccccttcttggccaaatccgattacttcgcagcctgcagatggcatcgccggctaagggcagcctgcggcaggtccccgagcctgagcactcctcctatctggggcctgagaggacgctctgggctttttcccaggcccagggtgcgcggcctgctagcgcctttcgaggcacagtcccaagataggctcttgtccttcgacgcccccttggcacaagcgcactggcgccctccgctcaacccaccttgcctttggggcgggcttcaaccctgggaagacaggcctgggggaagcgagaggagaggcccgaatagaggttccggctcaatctttcccagacggaggcctggtgtttccagctcagttgcatcttccagccgcgggctcctggcccaaacagaatgtgtttgctttcacaccgggacggcaagcggagtccgcctcagtgagcagcgagctgcgcagtccggacgggtgtcgcccccagagactcgccagccgcccccagacactcgccagccgtccccatctctaatccaccgtccaggcccgggccctgggaaga

SEQ ID NO: 104 - DNA, 800 bp, Homo sapiens
ccgtgtctcccttaagaactggggcctcatctccactccagctgcgcgtgcacgtgtgctcccggcaggacgcgcgcccaggagcgcgctgggggctgccccgcccctctctccctcccccgcgggtaaactccgggcatccatcagtctgttaattgcactaattagagatcgcagaggtgttaattggaaaaccctggtattgtgcctgtttgggggaagaaaacgtcaataaaaattaattgatgagttggcagggcgggcggtgcgggttcgcggcgaggcgcagggtgtcatggcaaatgttacggctcagattaagcgattgttaattaaaaagcgacggtaattaatactcgctacgccatatgggcccgtgaaaaggcacaaaaggtttctccgcatgtggggttccccttctcttttctccttccacaaaagcaccccagcccgtgggtcccccctttggccccaaggtaggtggaactcgtcacttccggccagggaggggatggggcggtctccggcgagttccaagggcgtccctcgttgcgcactcgcccgcccaggttctttgaagagccaggagcctccggggaagtgggagcccccagcggcccgcagactgcctcagagcggaagaggcagccgcggctttgacccagcttccttccgacggcatctgcaggagcctctaggcctgacataggctccgaggtgccctggctcccccacggggaatgctgagggttgggccactaggtcctgcctaagtgcaggacctgagcctcagacaaatc

SEQ ID NO: 105 - DNA, 300 bp, Homo sapiens
gggattgccggctttgagaaaatatgaagaaaccgatttctccttccactttgccagtgcactttccttccactttcactggtgctgggggcggcgcactctttacgacatataagcggaaaattctgcaaaagtggcccccggggatccccgcccgacccctgtctgtcgctaatgtgggcctgtctccggaaattcgaggttgggcctttgcctgaatctgttgctattgctccccttgctaccgctgacacttggcaccgccgcctcctagcagcggccagacgcggggctgggggc

SEQ ID NO: 106 - DNA, 400 bp, Homo sapiens
gttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctccttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtg

SEQ ID NO: 107 - DNA, 800 bp, Homo sapiens
cagtgcgccccttaccggagcacccatggcctcccgcgttaccccaaattttgtaggcagactgtcagagttcgaagccagctgtgtcctctgcgggccgtgtgaccctaggctatctgggctgctcggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattat

SEQ ID NO: 108 - DNA, 1000 bp, Homo sapiens
tttagtatttaaggagaaaagcctcattttccagaatcgaataagcgaattaatcgcacaattgtgtagaatggaactcagtctgtaaaaaatcaagaccaacgtactttttaatattctaacatctccaagtagtagttacaagtattgtacccatgaagtccaggtaattaatttgttcaatgtcacactgttaaaagtcaggtgggctccaaagcacagtcctaaccagcatgctctactgcctcctctgaggcaacagccgaagtgcagaccactgggaataaatagctgcccggtcttccccactcctaaattctcccgacagaccccaaagcctctctgagagcctctctgaccgccctgcggcccaccccgagttcccggcatcctctgggatccctcttcctggagccaaaacctacgcaggctcctttcctccgagctggttgctaggtgatctccgaaggctgtccgaagtctcgcgagggcggacccgttgcctgatgacgagagttgggagtgtggctggggctgcggatctccagcagtggcgttacttctagcggctggataccgggttctccgcgagatcgcgagatcccgagatattctccccgcacggaagcgacgactggcctggccagaggactcgcgtgggagcgaggtgccggccccgacaggacggtgaggtatgcagaagtaaggcggggcgccccctgcgggaagcgagcgcgccccggaaaatgagcgcctccccacaccaaggtgtccaggagtgagtgcgggaaggaactcggccgcccggagttgtggcctcatcgtgcttcccgccaaaaacgccttggtactgtcgggacgcggctaagcgtggacgcgcccgcatctgcccctcctccgcagtggtggaagacacccgcggagcgccggtggataagggccgtttcctgagaccagagctgtatccgcagcaggtcagcacttcgtgcgccctgtgtgc

SEQ ID NO: 109 - DNA, 300 bp, Homo sapiens
agcggcgctgttcccgggctgggtgcagctgctaaggacaaggcccctgctccgaagaacgcggtggctcggggataccctgaaagggacggccatggcgcacatgggatgccctagggttcgtgggagggcatgcaggcgcagcccccgcaggggttggcctgccagagaaggcaggggagagcactcggggctgcacaaatggtgtggccggagggaaggtgcagccttgtgtgtgtctggatgagggctgggcataggagcttggtatttgatcctgaaagctctgcgtttccaaag

SEQ ID NO: 110 - DNA, 600 bp, Homo sapiens
gagtcatacttgtagtcacatccttttcctttctccaacccactggttaatcatgaaaggctcttctgattggctgcctcctggcagtagtgcctcagcgcgacggttcgggagcaaataaataattcccgctgggaagctgtttctcagacaggagcagcgacacccctgccacgcctgccgcctggagttgagtggggtaagcacgccggcctccaggaatcgacggtgccacgtggttcttcttgcacttctcttcttctccagtttcaggggacaccgtggggtgtgcgagcccgggggagcgcagggaagggcgggttgggctgcaggtgggaatgtgcggtccttctgcgccctcaacagagcttccttcctttttgccaaggtccccgtgccgccttcagcgcgcctccttatgcacctctacctctgctgcagcgtacctcttccgcagccctagcggcctccccgaggggcgccgcggcctcggctgtccctcccctgcctggcacgaccacctgacccccagcgacccaagaagcaagttgtgtttgcagacgcaaaggggctgtcgttggtatcggtgcactggtttga

SEQ ID NO: 111 - DNA, 1700 bp, Homo sapiens
acactttctgtgtgggagggcacaagacatgggctatgacatggccagagaccccaccttctttacacatgtaaaaaccaaccaaatcaagatgcgtcaacggtgattcttcctcccacattgtttccctttttaaactgttattttttcaatccatggagcagttgagaaacgggtatgcatctctcctcccctccccttctatcaaagcctgtaagacacataaggaaatccaaagccacagtaatagagagagagagagagagagagagagagagagagagagagagagagaaaacagaacaaaagaaatcctccttggcttgtttttccagggtggccaggcaaggtgtgaaaatccatatttccctctgggctggcaggtagaagttactgggaaggctgcgctcccttctctcccaccggctctcacatccaggctgttccctcaccctcagcctcccccagcgccagcttcctcctccgcctctctgcagccaggcctcccctgcaaggcggaccttggcccaccttggttccgggccaaggcggcgggaaaggcaccgctacctgcagccgcacgactccaccaccatgtcctcgtactgcttgtagaccacattattgcccgcgtcgatgtatagaatgctgatgggagtcaatttggtgggcacgcagcagctgggcggggtggagccggggtccatggagttcatcagcgtctggatgatggcgtggttggtgggctccaggtgcgagcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccgacggcggcggccacgacccctcggcgcccgcgcccgggcccgcagcctcggccgagcccagctgctcgcgcatctctgcgaacaggttcttgcgctgggatctggtgaataccaccagcagggcccgctcctggggaggccgcaccctccggccgaagcccagactccgcaggtccgggggcggcggttgctggggtccccgcgcgcgcgcctcggcctccccggcgtccagctcgccccatgcggcccgcagctccaagcacagctgcttccagggctggtggcgcaggccctgccacacgtcgaagacttcccagccggccggcggcgccccctgcgggtccagggtccgcgcgtccagcagtaggggcgaaaggcaagggaagagctgcacgtggagcggcccggctggtggcccccagggcgctgagggcgcctggcgaaagagccgcagctccgcgcccaccagctcttctttgtctgagagcatggacacatcaaacaaatacttctgtctccggagaggagtgtgcgagagatcgtctgcgagataaaaaataattacagtcagtttcacttaagggggagatcagcccggtgctcttcggccgccccgggaggaaaagggcggggagtgggggcaggtcggccgggcagtccagcttgcccggcccagggcctgaccaccccggctccccatctggctggtgcatgg

SEQ ID NO: 112 - DNA, 2000 bp, Homo sapiens
gcccgctgtgaatgtaggtgaggtgatcccgggaacctgggtctgaaatcagacctgtgttgccattgggagcacggagagaggggaagcgccctgcttaggcccaggccgggcgtcctggtggtgggaccgcagccgcactcacctccaggccaacggacaaggttcctgcaagccagcagggccactctgtgcttggcctactgcagctcccctgcagctcctttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacct

SEQ ID NO: 113 - DNA, 2000 bp, Homo sapiens
cactcccccgccgcctccgcccctaaccctcggccccgtgcgcgagcgagcgagggagcgaacgcagcgcaacaaaacaaactagtgccggcttcctgttgtgcaactcgctcctgagtgagtcgggggccgaaagggtgctgcggctgggaagcccgggcgccggggacctgcgcgcgctgcccggcctggccggagcctgtagcccgggggcgccacggccgggctcgcagtccccccacgccggccccccggtccccgccgagccagtgtcctcaccctgtggtttcctttcgcttctcgcctcccaaacacctccagcaagtcggagggcgcgaacgcggagccagaaacccttccccaaagtttctcccgccaggtacctaattgaatcatccataggatgacaaatcagccagggccaagatttccagacacttgagtgacttcccggtccccgaggtgacttgtcagctccagtgagtaacttggaactgtcgctcggggcaaggtgtgtgtctaggagagagccggcggctcactcacgctttccagagagcgacccgggccgacttcaaaatacacacagggtcatttatagggactggagccgcgcgcaggacaacgtctccgagactgagacattttccaaacagtgctgacattttgtcgggccccataaaaaatgtaaacgcgaggtgacgaacccggcggggagggttcgtgtctggctgtgtctgcgtcctggcggcgtgggaggttatagttccagacctggcggctgcggatcgccgggccggtacccgcgaggagtgtaggtaccctcagcccgaccacctcccgcaatcatggggacaccggcttggatgagacacaggcgtggaaaacagccttcgtgaaactccacaaacacgtggaacttgaaaagacaactacagccccgcgtgtgcgcgagagacctcacgtcaccccatcagttcccacttcgccaaagtttcccttcagtggggactccagagtggtgcgccccatgcccgtgcgtcctgtaacgtgccctgattgtgtacccctctgcccgctctacttgaaatgaaaacacaaaaactgttccgaattagcgcaactttaaagccccgttatctgtcttctacactgggcgctcttaggccactgacagaaacatggtttgaaccctaattgttgctatcagtctcagtcagcgcaggtctctcagtgacctgtgacgccgggagttgaggtgcgcgtatccttaaacccgcgcgaacgccaccggctcagcgtagaaaactatttgtaatccctagtttgcgtctctgagctttaactcccccacactctcaagcgcccggtttctcctcgtctctcgcctgcgagcaaagttcctatggcatccacttaccaggtaaccgggatttccacaacaaagcccggcgtgcgggtcccttcccccggccggccagcgcgagtgacagcgggcggccggcgctggcgaggagtaacttggggctccagcccttcagagcgctccgcgggctgtgcctccttcggaaatgaaaacccccatccaaacggggggacggagcgcggaaacccggcccaagtgccgtgtgtgcgcgcgcgtctgcgagggcagcggcggcagggggaggaggaggcagaggcggggtggctggaccctcggcatcagctcattctcccctgctacacacatacacacacaaataatgtttctaaaaagttcagttgcgactttgtgcctcgcctgtcctgttcatcctcgtcctgggccggggaatgcttctgggggccgaccccgggatgctggctaattgctgccggcgggttccgtcgccggtgtgaccctggacggcgcggacggcgtacagggggtcccgggaggggcagtggccgcggcactcgccgccggtgcccgtgcgcgccgcgctctgggctgcccgggcggcgcagtgtggacgcgg

SEQ ID NO: 114 - DNA, 800 bp, Homo sapiens
ctgaaaagccgtcagggaaaccacacatgttcaacccctggcggctcccccaaacctctcatttccagtaactgtgtgtttccgctcgtcaacagctgaaaccgagcggaacttggggggccccaccacgcggccctgctgtgcggcacggggctcatctgtcccccggctgcggggagtcagctctcaccgcccacctccttcccagatagtctctgtgcccactcgacggcccggcaagcccagcccctgcctgccacggccacagcagcctcagagagctgccctctctggccagggtcagggcctgagctgctgcctcccgcagggtcgagggcaggacacttgtctgaggcttgggtggggcaatggcacctcctcagggcctcagcccccgggcaggctcggtgaccatgggcctacagcagggaaaattctgggccaaaagctccagcctcctactagggcatctgtctgcaaatgcaccttaacctgaccgcttgggctgtgggggagcctgtttcagggaaagtgagggacgcgccagtttcctcctttggacttgatgaggcacgaacgcatctctaataaagccaggtctccccgccgtggctccctgggcgggtgcctgtggctcgggccatgagtcacgctgggtaaccccactacggggaagagggcaggaagctgggagccaccgcctctgtgcccggttgtcatctcggcacgagggcgaccgtcggcttcgtcctgccctcatggctgagggcttttgggatgtggcgggagacgggggagtc

SEQ ID NO: 115 - DNA, 500 bp, Homo sapiens
aaatcatcagaatggctaaaatgaaaaagacagacaacagcaagtgctgacaagggtgtggggcggccaaatgctcctgcactgctggcaggggacctgagaactgcagggcattccctggcttcctgcccctcctgggactggggaccccccagggacagcctaagggaactgcatttatcttcacgtctgccaaaagataacacgaagatgttcaaagctaagcccccaggctggtaagagctccaaggcaccagcagtgtgtgcagaactggggggagtctgttctcccagggatgctcccatcacctgctgccagcagtggggcatgccggtcccctggggtgtggccaaggggctgtgtctcctgcccgggctgccggcccctctcaggttcactttcccatctctaagcccacgtctcgctgcagttcaagtttgccaggccaccaacgggtgacacgcccggcgcagtgggggactccgcactttctgcgcac

SEQ ID NO: 116 - DNA, 1200 bp, Homo sapiens
accctttgtgcctgggtcccataaacaatgtgctttttaaaggggagccccctcccagctccggcctttttctccagcgtgggcagccaatcagctgcgcagagctgcatagctggaccgctttccattctgagtagcaacaacgtactaatttgatgcacacatggatgcctcgcgcactctgcaaattcatcacccgcatcttgcattagtcatctgacggactgccaagtgtttcattttctttccatgtgactttattattaccacctctctcctctcttccaaaaacctcccaaaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggtacagagcgcggggcgggggtcgccaggcgtccaggtgggcgtcgcggggcactggggctgtccgagcccccagcctgcaggaggaagggcgggtaggcaggagggctggaagcagccggtgctggcggcccctgtgctccaggggctgctcccgactcctccccgcacccccgcccgcctgcccgccgggacaggttggaggcgggagagagggaccgaggcagggcgggagcgcagaggctcggtc

SEQ ID NO: 117 - DNA, 800 bp, Homo sapiens
taacaaataagccgcccgtggtccgcgctgtgggtgacccttggcgccttcgaggtctggagccctagggtaaataaggaaacggggcgcctctagagttttaaatgaactctgttattggaagcttcagtagggaccctgaaaacaattaacgtcttaattagcattttaatgtctccattattacggcgcgggctctagctcagccctttaccttaccttctcaccgttaacaggggagggggattgtatttttagttcatctttttatgtttttgagttgttatcctgtctgtctgattccagcctcgagggtttgatgatgcggcccgagcctggctgtggtcgcctgtcggggctggagcgggaccctcagccgggccgggcctgggggctaacgttttcacagtgcgccctgagtttccttgggttactgctgggaccgcgcaggaggaagcaaagagtttttcgagctagaccaacaggaaacacattgacggaaatgttgccatagcccatggggtggctttaactggccgcccccgcgggctgggtgtgaaatcagaggaggccgcggctcccccggccaggattggaggctcctcgcgcaacctaatgcgggtgtccgggcccgagcgcttcccgcgcagccaggccttgtcggtgcagcagccccgctcctccccaacacgcacacacccggtgttcgcaagtgcggctcaccaagggagatccaagggggcaaaaagttatgtataaatccgagagccactggggaaagagggtcgtggtattgtaag

SEQ ID NO: 118 - DNA, 500 bp, Homo sapiens
ctaccctgtgctatcctgagctgtagtcttctgaaatgatcgtttggcttcccagccaaggcagggctcccccaaagttcattcccactcttgcagtttcacctcgggatgcttccgcagaatttcagcgcctaagcagacaaggtcaaagtaaaccgcttcaccgctgcttctggcgcaggggcccagagcgcgtgcagctccccagcacagaccaacagcaggagaggggtccgggcgggagccctgggctgtagataagcaaaacgcacccattttctctcctatttactccagaggcacctctcctcccccactcctggcatctctttatcactggctccctctccctgtggcatatttttgggtagtagaatgctgaggtcacagggagcggctctttatccaagcagtggggacatcagcctggagccctgagcatgaaccagcaagatgcagactctcgctcttgactttgggctccaggagctgccccgacc

SEQ ID NO: 119 - DNA, 1100 bp, Homo sapiens
cagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtgacaggcgtttgggggatctgggctccggccgggaccagcgcaagcagggactttgcggggacaccgcttctccaacagagcaaggcctggcccacgtttccggtttctcctaacttccttttattgccttcctttgcttcgcaagttccatctacccctccagctacagagccccacctctaggcacaggaagcttcccggaaaaagaaaggctgtcccagaaagagaccgagagagactttccaaacttcgggcatagccacggcaattcccagtctgctaatgccaaggcgggcgcgtaaggccgcctaaatctagacctccctcctcactcatttcaaaaaataacaacgtgccagccacctccgcagataccgccggctggtgcttgcccaggagacgccagggccagagcgccactcccagcatcgaaatggcagagagaaagcgcagctccaaattccccttcagaggttaagcctcaatcattgtgtcccttccctagggactgctggcgctctcgcccactggcgatgattatgcgcctagaactcgaccgcgaagcaactaataggaaaacatatggtgtcaatttggatgctccgcgcctcgcgcacacccgggaacgagcggcacaaagccctgccggccggcccgcgaccccgcgcccctcggggcctgccagccgggccgcagcgacaaacgctcagggctgcgcgccctggctggggcccgcccgagagacagcctgcggctggggagtctgagctccaaggggagagcccagccgccgaaggcgagcctaccggccaagccctggggtccggcaggttctgcacaactactcccgcaaagctcgccacctttgtgccctttcctcag

SEQ ID NO: 120 - DNA, 500 bp, Homo sapiens
gggccctcgcggctcaagcgccagcgctggagagagagtctgagggtaccacgggcgtgctggcctgggtgctcactcccgccctccttcatgagcggctttcctctgggtgtgtccagggcatcacagagctcttctgcccaaacccggaggcctaccagggcctgcccaccttgcctccttccacactctctgtagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcagtgagtgtccgctgcccgcttgctgaactcggcaccatgggcggccgccacgggtgtctctgggcacttccgggccatccctgctgctcagctcccgataatggtgtcacggtgactcaggcattagc

SEQ ID NO: 121 - DNA, 600 bp, Homo sapiens
tgtttacggaatcgggatcgaggggccgataagtagtttacacgccggccagagcagagggctggaggtcggagttgggggctggaggaacgggtggcgtttttaggattcagtaacaggatcacagctttttcttgtggtggaagctattggaatttggggagggtagcacgaggggtcctgcagctccgcgtgtgaaaaagcgtttaggtaggcgatgaaagtagttgatctgagccatggcaggcgagccccgaatttttgctgcttccccctgaaagtgtttctttaggaggagaggacttgggccacacaggacccggtcctaagagagcgattccgggaagcggacagatcgaagagaccttctgggcgaagcggcagggcagcctcgcggggctgggagtggatctgaggtcccgacccaggcggctcggagtgctccaggagccacctgggtctgcgggcgcagcgcggcggggcgggagcggtggcccgcaggggccgcggcctgcgatgaaggccggggggcagcgctagcagcgaggtgccacagtgggccgaggagtctgggctgtggcccagggtaggaccggctca

SEQ ID NO: 122 - DNA, 150 bp, Homo sapiens
acctaaaccaagctctccctccctgccgtctccttccctggcctgggtctgaaggagaggaggtgcccagaagttcagagcggcataaccacagagatactacctaattaacataccagaagcataaagaactcatttgcattggagagt

SEQ ID NO: 123 - DNA, 900 bp, Homo sapiens
ataactacgggggtgggggtggggaaggaagagatccaaggaggcagaaggctgcggtcaaaatattttggggtggcagagtcacgtaggatgtggctgtgggttctggcagcccagagattcagctcccgcctcctccctcagagcgagtccatagctaccctcacgtcccccgtggcggtcctcgccacgctccggagcgggttacccatgagggtgctagacctgggcagcgggaacctcgaagaggtggagattgcaggctgggactccagatttcgggcagggatgcggggaagggaagacgcctcgctggaggcggaatggagggcaaggcgaaggaggatggtgcaggaaacggcgacaaggcgcccggccaggcccgcgagctaccgagacccgggttccaatcctccccccttccgcaaacgcccgggttcgaggtacctggcgggcaagggccgcagcggagcgaagcgggctggccatggggaggctgcggggacgcggggctgcagagagcggcagtggcacggagcgcgcggctggaagcgaaagcaggcggtgtggccaagccccggcgcacggcccatagggcgctgggtaccacgacctggggccgcgcgccagggccaggcgcagggtacgacgcaacccctccagcatcccttggggaggagcctccaaccgtctcgtcccagtctgtctgcagtcgctaaaaccgaagcggttgtccctgtcaccggggtcgcttgcggaggcccgagaatgcgcgccacgaacgagcgcctttccaagcgcagatatttcgcgagcatccttgtttattaaacaacctctaggtgaatggccgggaagcgcccctcggtcaaggctaaggaaacctcggagaaactacat

SEQ ID NO: 124 - DNA, 600 bp, Homo sapiens
cagtccagccgcttgcctcacttcttcccgcttgccttatctccccgcagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgc

SEQ ID NO: 125 - DNA, 1500 bp, Homo sapiens
caagatcgactttcttaggaagggggagaggagggaactcttcacgaagggaggtgggagtccacctcagacctctattggaaggaaatcgagttgttccgggggactgaggtctcttgcataaggcatgggatccttattattattattattatttttaaatcccccgcggaggagctctgggcaaatgaataccgaggcgccgctctagctggttaggcttgggatgcgataactcagtgccctcttgcagacttgcatagaaataattactgggttgtcgtggaggggacacgagacagagggagttctccgtaatgtgccttgcggagagaaaggtccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttgagttgcaaaacgtaccgcgtagacgcccctggtggcgccgagagaagagctaggcctgcccagcacagagccggagagcgtcgggccttccggaagggtaagttctccgccaaggggtcccgagggagctggacgtctgaatctggacttgcccccagcttcggggttcgattctgggttttgcgcgtccccaacccccagggctttccgaagcatggcctggctccaggcccggtcctgtaaggactggaacggcagcaaaatgtgcagggaggcagtcggccggcagagctgcggcgggagccaaggtcaggcccgcggggagagcgggcagcttccagcgccggccacaagctcccaggccagctgggccgcagacccctttgcttccagagagcacaacccgcgtcctttctctcagccaggctgcagtggctgccccgagcttcgctttcgtttcccaagctgttaataacgatatgtccccaaatccgaggctcgtgtttgctcccagatgccaagaacgcaacccgaaatccttctcccaaaccctaggtcgacgagatgagttcctacttgacctctgagccgaggtgggccggaaaccgaggcctaggccccgccggggctgcaaggaaaaggggaaactccgagcgtagcgtcttttccttgtggttcctttctccggcatcccggactgcgggccctgcagccacctggaccggcattcaaaggattctgcaagtccagcttcacagactggctttcccagacgctccgaagcccgcaccacgaacagaataaaggagagacgagagatcgcaactagatttgagaatcctcgttcttttccccaatcgttcgggcagtaaactccggagccggctacagcgcgcatcctc

SEQ ID NO: 126 - DNA, 500 bp, Homo sapiens
actgtcctcctccctcaattgcctattttttgcccatagctctaacttaaccctgtgatcaccccagatcgctacttctgacccccatctcctctcccacaccaacctccagcgcgcgaagcagagaacgagaggaaagtttgcggggttcgaatcgaaaatgtcgacatcttgctaatggtctgcaaacttccgccaattatgactgacctcccagactcggccccaggaggctcgtattaggcagggaggccgccgtaattctgggatcaaaagcgggaaggtgcgaactcctctttgtctctgcgtgcccggcgcgcccccctcccggtgggtgataaacccactctggcgccggccatgcgctgggtgattaatttgcgaacaaacaaaagcggcctggtggccactgcattcgggttaaacattggccagcgtgttccgaaggcttgtgctgggcctggcctccaggagaacccacgaggccagcgctccccgga

SEQ ID NO: 127 - DNA, 900 bp, Homo sapiens
ctcagggaatcacatgtccgcctggcctggcctggtaccaaatgtttatagacaggacgagggtcgctggaatcgcctcgctcctttcagcttggcgctaaggcgcgaatctcgatcctcctagtatttctctggcgtctgtctctatctcagtctctgcttttgtctctttctccctccctccgccccagtctttccgtctctttttcctcgaatgcacgtggaattcggaattgaaaattgaggtcagaatctccctttttcttccagttatccgcgccgctgccccacgcctagcggcttggatctgcatagacatctatctacccgcaacaagatccgagctgcagaagcaaacctaatctgtctccgcaccatcccctgctctgtagacccactgccccatcccacgccacatccttgaggttcaagtagcgactccagcggatgattcggagaatgccctgctttccaaaggccccaacccgtgtttttattttctttttcctttgcccgcttgaccaactttggtttctttcagggcccggaggtgcctgcgccgcgcttggctttgctttccgccgccccaggagacccgggactgtggtttccgctcgccacatcccagcctggtgcgcacacaagagcctggcgagcttccctcgcgcgcttacagtcaactactttgggcctcggtttccctgctccttgtagatcagagaagggacgggcgaaatgcctgcgagggagggttggcgaatgggttggttggtggcaagactgcagttcttgtacatggacgggggttggggggtcaacactggaagaactcctgcctgacgccaagagccacccgctttccagctcgtcccactccgcggatgtttacccaccttcatg

SEQ ID NO: 128 - DNA, 500 bp, Homo sapiens
tttggggcacccaacccttcccaagcctcggttttcccgatcttgtgggatccttgcggcgcgaatggggttggaagcaccttggaagctacagagtaccgggtcgggacaatttccggcactgccccagttcagtggtttatagaaaatttctttctctctctcaggtccactaagaccgagagagagagagaagtcgactctggcacacccgggcgaggggctgccgggattcgggagctggcgcggttgattttttccgagaatcctccacttggggtgacgtcgggcagcgcgcgcgggccgtgaggttaatgcccaggcttttctctaaagcgtccgggaatgatccggcgaataaaacgggtgtctgcaaagttaatgaattgtacaaggaggctgagggtggggacttcgacccggggagccagaggcggttctggtggacgcttccccgtgcgcctaggggtgcgctgggctttcccagccgaggtctgcag

SEQ ID NO: 129 - DNA, 2000 bp, Homo sapiens
ccagacagttaaggtaaaacgttgaagtcaagaggaagtagtgagtctgttgccaactggatagggttggtcctgtcccatctaaatgtattagaattaagtggcttttaaaaatgagctggtcatcttcagcccacgggctggccaatttggaacttaatgggcctttgcgtcctccttccctgagcctccttttattccagacttctcagtgtgagtctgtgcgtccctccgacgatctcagggagtggggtgccttcatctgcctgttccctgttcctcaggctgacgctcccgctgtcctccccgcctcccctcactccttttctccctcccttcctccttgtggggaggctcttggccagggtccctgagcccgggcgggtgctggcagaggacgcagaaggggtgaggtcacgtctcccttgagccccgagccgctggcttttcagagcctcgccacaagccggcggccagagccccagaccacacagaccgtgcgctcctccgccctcccggcgccgccggcctcgcccatgtctcagtacgcccctagcccggacttcaagagggctttggacagcagtcccgaggccaacactgaagatgacaagaccgaggaggacgtgcccatgcccaagaactacctgtggctcaccatcgtctcgtgtttttgccctgcgtaccccatcaacatcgtggctttggtcttttccatcatggtgagtgaatcacggccagaggcagcctgggaggagagacccgggcggctttgagcccctgcaggggagtccgcgcgctctctgcggctcccttcctcacggcccggcccgcgctaggtgttctttgtcctcgcacctcctcctcacctttctcgggctctcagagctctccccgcaatcatcagcacctcctctgcactcctcgtggtactcagagccctgatcaagcttcccccaggctagctttcctcttctttccagctcccagggtgcgtttcctctccaacccggggaagttcttccgtggactttgctgactcctctgaccttcctaggcacttgcccggggcttctcaaccctcttttctagagccccagtgcgcgccaccctagcgagcgcagtaagctcataccccgagcatgcaggctctacgttcctttccctgccgctccgggggctcctgctctccagcgcccaggactgtctctatctcagcctgtgctcccttctctctttgctgcgcccaagggcaccgcttccgccactctccggggggtccccaggcgattcctgatgccccctccttgatcccgtttccgcgctttggcacggcacgctctgtccaggcaacagtttcctctcgcttcttcctacacccaacttcctctccttgcctccctccggcgccccctttttaacgcgcccgaggctggctcacacccactacctctttaggcctttcttaggctccccgtgtgcccccctcaccagcaaagtgggtgcgcctctcttactctttctacccagcgcgtcgtagttcctccccgtttgctgcgcactggccctaacctctcttctcttggtgtcccccagagctcccaggcgcccctccaccgctctgtcctgcgcccggggctctcccgggaatgaactaggggattccacgcaacgtgcggctccgcccgccctctgcgctcagacctcccgagctgcccgcctctctaggagtggccgctggggcctctagtccgcccttccggagctcagctccctagccctcttcaaccctggtaggaacacccgagcgaaccccaccaggagggcgacgagcgcctgctaggccctcgccttattgactgcagcagctggcccgggggtggcggcggggtgaggttcgtaccggcactgtcccgggacaacccttgcagttgcgctccctcccccaccggctcacctcgcctgcagctgggccacggaactccccggccacagacgca

SEQ ID NO: 130 - DNA, 600 bp, Homo sapiens
ctctctgggccttaggaaaatggaaatgacacctgtacctgcccttccaggactgacaggaggggctgctccatgaaacctcactgctgcggtcataatgtcattatcttttgccttaaagggatttcttctgcaccagcacctaaagtggcagccccttacccttggccatcagctggaccctggtgctctcctggagcccaaaacctctgttttgtgttgcatcctgctgaccagccacagtccacacccatctgagtgtctgagcagaacagcccagaggccacaccaggatggctttccaccggtcaccttcccccacccactcataaaccctgcgtctctgggggagagggtggcgaggtcccctccccacatagatggaaacactgaggcctgattcatggtgccccctgtgaagcgcctcatggccagcaccggggggcagcaggccagggcggggacacatacccggttctcgtcgtagatgatctgcaccaggctgcggtgcttcgactcgatgggcggcggtgacacgggcttctcaggctcgggcggcttggcagcctcctcctccagctgttgctgtggggagaggca

SEQ ID NO: 131 - DNA, 400 bp, Homo sapiens
cttgaaaactcccagccccctttgtccagatggggatggaggtggccaggctgccccgttgattgtgtgccgaggagccctccccgggaaggctgtgatttatacgcgcaggcttgtcacggggtgaaaggaagggccactttttcattttgatccaatgttaggtttgaaagccacccactgctgtaaactcagctggatccgcgggccgtgattaaacacattgcccgctttgttgccgagatggtgtttcggaaggcgctgtgaatgcacttccctttgcggggctcacacagacaagatgtgtgttgcaaggatgaggcgcctgctcggcctccagcccagggccgggaagggagaaggtgctgtgcgtcgctgcctgtgtcgcccgcggctctcc

SEQ ID NO: 132 - DNA, 1200 bp, Homo sapiens
cgcgtcagggccgagctcttcactggcctgctccgcgctcttcaatgccagcgccaggcgctcaccctgcagagcgtcccgcctctcaaagaggggtgtgacccgcgagtttagataggaggttcctgccgtggggaacaccccgccgccctcggagctttttctgtggcgcagcttctccgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggccgcggatgcggggcgggaagggtgga

SEQ ID NO: 133 - DNA, 2000 bp, Homo sapiens
cttccgccgcggtatctgcgtgcccttttctgggcgagccctgggagatccagggagaactgggcgctccagatggtgtatgtctgtaccttcacagcaaggcttcccttggatttgaggcttcctattttgtctgggatcggggtttctccttgtcccagtggcagccccgcgttgcgggttccgggcgctgcgcggagcccaaggctgcatggcagtgtgcagcgcccgccagtcgggctggtgggttgtgcactccgtcggcagctgcagaaaggtgggagtgcaggtcttgcctttcctcaccgggcggttggcttccagcaccgaggctgacctatcgtggcaagtttgcggcccccgcagatccccagtggagaaagagggctcttccgatgcgatcgagtgtgcgcctccccgcaaagcaatgcagaccctaaatcactcaaggcctggagctccagtctcaaaggtggcagaaaaggccagacctaactcgagcacctactgccttctgcttgccccgcagagccttcagggactgactgggacgcccctggtggcgggcagtcccatccgccatgagaacgccgtgcagggcagcgcagtggaggtgcagacgtaccagccgccgtggaaggcgctcagcgagtttgccctccagagcgacctggaccaacccgccttccaacagctggtgaggccctgccctacccgccccgacctcgggactctgcgggttggggatttagccacttagcctggcagagaggggagggggtggccttgggctgaggggctgggtacagccctaggcggtgggggagggggaacagtggcgggctctgaaacctcacctcggcccattacgcgccctaaaccaggtctccctggattaaagtgctcacaagagaggtcgcaggattaaccaacccgctcccccgccctaatccccccctcgtgcgcctggggacctggcctccttctccgcagggcttgctctcagctggcggccggtccccaagggacactttccgactcggagcacgcggccctggagcaccagctcgcgtgcctcttcacctgcctcttcccggtgtttccgccgccccaggtctccttctccgagtccggctccctaggcaactcctccggcagcgacgtgacctccctgtcctcgcagctcccggacacccccaacagtatggtgccgagtcccgtggagacgtgagggggacccctccctgccagcccgcggacctcgcatgctccctgcatgagactcacccatgctcaggccattccagttccgaaagctctctcgccttcgtaattattctattgttatttatgagagagtaccgagagacacggtctggacagcccaaggcgccaggatgcaacctgctttcaccagactgcagacccctgctccgaggactcttagtttttcaaaaccagaatctgggacttaccagggttagctctgccctctcctctcctctctacgtggccgccgctctgtctctccacgccccacctgtgtccccatctcggccggcccggagctcgcccacgcggacccccgccctgccccagctcagcgctccctggcggcttcgcccgggctcctagcggggaaaaggaaggggataactcagaggaacagacactcaaactcccaaagcgcatgattgctgggaaacagtagaaaccagacttgccttgaaagtgtttaagttattcgacggaggacagagtatgtgagcctttgccgaacaaacaaacgtaagttattgttatttattgtgagaacagccagttcatagtgggacttgtattttgatcttaataaaaaataataacccggggcgacgccactcctctgtgctgttggcgcggcgggagggccggcggaggccagttcaggggtcaggctggcgtcggctgccggggctccgcgtgctgcgggcggggcgggcccggtggggattgggcgc

SEQ ID NO: 134 - DNA, 1000 bp, Homo sapiens
agtttggggagccttttctccatttgagaaaaaacaaacttacagcgaggggtgaggggttagggtttgggattggggaaaatgtgggtggggagcccccccaaggaagtgaggagggggctgcaaggattacacctgggcatacgtttccctagaaatcacattcattgtatttttataatttattctaaatctttcatgcgaagaaagtcagtagtgagtgttagtactggtggccctcctgatcacacttgcatctcttgagtgtgccttaaaggtcttgggaatggaaaatataaaaactgcttcgtgatgcgtcatctttatcccccactcccccacccattccaatatattttctacttccagcctaaattcggggccccctaccgaggccggccatgatcttgagggcggcataggggaggccgcgctctgtccaccccagcctggtgatgccgttcgcttcttgtgcccggtattgtgggctacatgcctttccggcgtacggagctgagcgtccaggccagtgcccctcaacctctcagtaatgtttacccgaggccgtcgtgcaatgagactattcgcatggcattgtcaacgcggcggcgcgcgcgtctcggccctccgcggcttgccagactgtcctgcaaaccacctcacccgtctctttggcgcaggagactcaggctgtaaccggagaaaacacttcaccctggaaccctaactcaggtcctggcaaaagatgcgagaggaagacttgctctcttaataaatctcggccgcccgcacatctggcccctagacctgctcggtagaggactggctggtggatgcgcggtccaggccgtgggcactcgacccacctctattttccttcccgaggcgcccctggattaccactttcggtttgcgcttacatccgggatgtcgaatttcccagggaatcataattattttatctataatttattctaaccccaaggttccaagaaaatct

SEQ ID NO: 135 - DNA, 1100 bp, Homo sapiens
acattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggagatctcaccgatcgaacgtttaaaaatggctttgtcttcattcagctctcccgatttattctgtgttttacaaatagaagctcagagcttctgtcgcccagtccttgcatgactcatggcggtggccacacgggtttcagggataacgggatgtttagaaaatcgctgcatatcggagtttcctagcacgttccatttatactgaacgcaggcggccgctgaaaatccagcctcgactcttgctaatgactgggtaggaccctcggggtcctgcgacggtgctggagggtgttcccggctccgatgtggggaggcctgcgcggggactaggttctcgagaggcgagcgggcgcgccagagaacccgagactgctgcggggccggatgcgggatccctgggctgcggttctacgcagaaacgccaatggccatgcctccccagctcctcccagccccagtcactaggccggcgcctggcccggagatcctcccagagccctggcggtgccatcatgccggagaagacaagctcggccccgctggaattcgctccaaacacagatgctcatttttggaatattctagaaaaataacaagatcttgtttgtcgttatgattcacgggaggtaactgatgggagggccatttacatgagggcagacactgtggggcgaaggtgacttctggacgtaggctttaaagtaggaacggctccaaattcccaatatctccggccttaccggttgcaaatcggacccctgcgggaaaaccagacacttctgtttcgtggctttcgggctgcctccagcccacgcaggctcgtttagtccccgtggagtcagccccgagccttcctagtcctggaacaagggctccaggtcgcggccgcgggaagccgccaagagggcggggagtagggattccctccagctccgcagggcatc

SEQ ID NO: 136 - DNA, 1500 bp, Homo sapiens
tcctcctcggcctcagatgtcgtcccacctgcccacgagcagggaacctggaacccactctcccggcagtccccagcgggttccgccacccggcggccgcccctgacaccgagtgggtgggaggaagaggcagctggcggggatgggccattgagacctcttgaaaaatattaaaagacaggatgggtagagatttctccgggagaaagttcgagggtgcatcgggtcgcggctgggaggagtacccgaaatgccagcaggagaaatgcaacctgtttaggccacaccttcaatccccgaggctgtctggagagactgcgtgcgggggacttgccggcgttcccacaccgcgcctgcaatccactcccgcggctgcctggcctctgccactcgcggcttgaagccagtggctctcaagccctcggccccgcggcggcccgcgcagccttcacccggcgccggcaccacgaagcctggccgcagtggactccccgcagctcgctgcgccctggcgtctcccgtcgaggagggagggacggaggcctgagccgggagctccctggcggtggtcgggccgccccccttgaggcctgctcccccctctcggcctcgccaaatccctgaaagcccagtcccccttcgtcaccccgggggcttctaatcactcggtatcgatttccctaactcttttcatcctgttgaagacacatcttaaaacactccagcccggagtgtgctctgggctttatccacactaataaaatgatttacccttctctccgcgctctcctcacagaggaaaatcgttcgagccccggctatttgtgtgtgatcagtaaatatttagtgcgctgacatccttagctgggcttcggatcgattcggggcccaccgggaggtgcgcacggtccgggcggggccgcgccgagctcgccgagggggctcctcccgccctcgccgccggccgctgatttacggcccctgcaaccagctaaggggggcgaaagcgcgcctggaaaattggcttttcaaccttttacttttgacattcagccacttccccaggctctaattctcgcccgcactcctccctcccgccctactaagggttgccctgtgcgccctgcgagcccttccagcagcaacgcgcggcgctcgcgccccctcggcccggggaccacctatcacagccctgagccgcgacgcggggaggccccggcccctgctatgggggtcgcctccttcgaggagagatgctctccgcccgcccacacctctgagggaggagagggggtggagaagcccagagctgcatctgctggatgacgagccgctctccctgctaccctttctccgacccgtcggcctttctcctactctggagactgatcctcgacgtccatcgggccggatggcgtcgggtggaagcgttactttcctcgcagaaaaactcctcctctttcctaagatcagaaaaagcgcttagcttggaattgttag

SEQ ID NO: 137 - DNA, 600 bp, Homo sapiens
cctaggcattctcagcccgttttgctggagggggcatttgaggcctggccagcttagccagcctacaaggagtgttactggggtgaaaacagccagcggggaccagtctgcttgtggcccgccaggtgcctgggatggggaagcagcaaatgcccaccttcctgcccaaccccctcctccctcttcatggggggaactgggggtggcagcggctgccgggtgcgagcgggctcaggcctgtggccctgcctgacgttggtccccatcaagccatgtgacgagaccaggccacaagaaagaggtttcaacaagcgttatcgtttcctggaactccaactcggcgacttccccgaagaccggctgtgcctggcgggcgggctgcgcacagcggggacaaggctgcccccttcctcctccgctgcctccgcggccgcgtctatctcagtctgactacctggaagcagcactccaccctccagcccagcggccctcggctcagctgccaggtcaccggcaaccccgggagcggtggggcaggggctgctccgccagcctctgtgatgttcaggccgggctgcaccagcccgggacccctaggtg

SEQ ID NO: 138 - DNA, 700 bp, Homo sapiens
gcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagt

SEQ ID NO: 139 - DNA, 300 bp, Homo sapiens
tgtccgacaggcacacagagcgccgccaggcacggccctcattcttcaccccgagctcccgcaaggtcggcgaggaggctggagcagcgggtaggaagcgggccgaggctcccccgacgctgggccgcaactgtcatcgcagatccctgaaaaacgagctctgtaatcgttgccgtcagcgggtgtacaattgcagccttatgtttcctgccgctgtttaccttcctgagcggcgcccagagatgcacacacgctgccctgaagcgggacgtgacctctgggcacctgtgaggtcctggg

SEQ ID NO: 140 - DNA, 500 bp, Homo sapiens
gtcggctcctgcgctcccaacggggtggccgtttccttcctcgcaccctcttctctcccggtgcctgcggtcccaccttccagatacccctcggagagtccagctgagctctcgccagagctttccccttccaacccgctcgacttgcccagatcccaagctgggcttctctctccatcgccccagaaagtgggtcttggagaccgaggcaagaatttgggcctccgcttctgttccagaccccggaccccttgccaaaatgcggcagatgtgcagattgggccgcgcttggttcctggctgggtttatggagcctgcggctgaggcaggctccgcagaccccgagccagagtgggatttaacggcggccggtgcgctgtgcttggtcaaccccggtaaccgtcacgctgctagtgatatgaaaaaaacctgccagcgttctgcttttctgccccgctgcagtctttagcacccgccaggattctgtccgagtgtttgga

SEQ ID NO: 141 - DNA, 1000 bp, Homo sapiens
tttagtgtgtgcataaaacatcccagctaatctcaaatagacttttcctgagcagaggctgaaatttgcaagtaatgcaaagaagactccgggagagcgtcgccgatggtggagcgggagacgggcgtggggagccccactgcagtgctgggatcgaagtggtgctgaccccaagacctctcccctcctcctcccccgggagcttctccagggttatttgggaaatgagggggaactccaatccctgagaaagcgctcaggggcttgctgaggtgagcgcaaatggaagcacaaggccgggctggccgtgggctcagtaaccagtcggctgcccggcttgcgccagcactaaatgctcgatcagaaagagaaaaagaggcgcaataattccaaatttcaggaaaagtcaaatcggagaggggggacgcaggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctagggcgtgcggtaggcatcgtatggagcccagagactgccgagagcactgcgcactcaccaagtgttaggggtgcccgtgatagaccgccagggaaggggctggttcggagggaattcccgctaccgggaaggtcggaactcggggtgatcaaacaa

SEQ ID NO: 142 - DNA, 500 bp, Homo sapiens
catggtgcttcaggaagggaggggacgagagccctgggcttgtggtgtccacgtggacagctaatgaggagccttgccgatgaggagcatgcgttcccgacggggcggccgaatgcggaaggagccgccattctctccgccctgaccgcgggattctctgcagcagatgagaaacggcgctgactcagcagggtccctcccaggccccgagcggtcatctggtgacccccgcgcttcccccacggcccagccggagaagggcaaagggaagtcccggctccaaggcgcacccagagatgcggtgcatgtggcaggatggcccagccccgtcggcagccccagcttcctgcccctggtttccttcctcccacgggctacaggcctctgatgagctttggaaagcaggaaacacacaggctagtaactatgaatgggtccaaaaaacactccttattactttaaactacttaggaagaagcacagcgttgccaaacgccaga

SEQ ID NO: 143 - DNA, 1200 bp, Homo sapiens
gcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttcgcggctcccgctcgctcagctttcggatgcgggagcccctgtccagcatctccagcgtgcggagcatctgaagttgcagtcttgcgtgtggatggtgcagccaccgggtgcgtgccaggcaggccctcctggggtacaggaagctgtgtgcacgcagcctcgcctgtatggggagcagggaacgggacaggcccccatggtcttcccggtggcctctcggggcttc

SEQ ID NO: 144 - DNA, 600 bp, Homo sapiens
gggcgggttgccacactgtcccctttctgcatgggaggaagggggctcgagaactgagtcagccacacaaaacgaggatggacagaactcctgagtagcgagggtgcctgccgggcgcgaggaggagggggaagacgaggaagacgaggaggaggaatagggagcaccacatgacagaggggctgcctcagaccacaaagcgcttcctcatcctttcctcgccctttgatgccgccggcaacgtgactctgcgagcagcggggcagacgccaggtctccctcgcaggcgggaaaggggctccaaggcgggtgctgccttgctcgggtcacatggctacgtgggggccttgctcaaattcacttcctgccttcattacaaaactgtcaaaggggatcgcacgtttgcagggtgtcacccaagcattctggttttgcaaacgacgctgtgcggcaggcggtctgatacctgatgagctcggtgtggcggggtcggcagcatttcctccggggttttgagctctggccacttctccttttgttccacccaatctcacccacttctgggcttcgaggccagagtgtcttaacaagggggcacgt

SEQ ID NO: 145 - DNA, 500 bp, Homo sapiens
gagcgagactttgtctcaaaaaaaaaaaaaaccaaataaattgaaagctgagaaattcagagcacaagaagacaagcgcgccccctcttttagctgtcaacatggcggagccgtccctggtgacgcagcctccaaaggcctccctgtgccctcctgagaccgcaagagggaaagtggcagcgacagtgatcgtggtgtctttgtggcggttgtgttgacctcactgacccccgaagtgccgctctagggtctgtcctcagcggtgacccggccgggtcgaagggcagagttccgctgtcactagccctccacccgtcctgtgtgctgggatgccctcgcggcgccgtccacgccaccgccgccccctcttgtgggttctgtctcctccgtgtctaggatcctcctgcatccgtttttccttcctcccttctctccctccgtctgtcttgcccgcacctgaggttgtcgcagaggcgctgagacgggccagcaggagctgt

SEQ ID NO: 146 - DNA, 600 bp, Homo sapiens
tgctgtcccggtcctgtcgcagtcctcaaagatgctagagtgacagtcctctaggggtagagatggtcgtcctcccaggagaaggtggcccggagacttggaggtgggatcaatcctgccagtcctggatcaggaggcctctgtcgggcgccgccccccttcctcctccatcagcaacaggcggcgccggccagcctcatagtcagcctcatccacactgaccagcaggcgaacagcctcccggcccacagcctctcgcagggcctcagtcaggaacacgccccgcagggcctgcagcagggcgccactcaggtagtcgccccagaaggcgtccagataggagagctctgagaacttgatgtcacaaaccacagagcccaggtcccttgagcgcagcactgcggtggcctgcccaaacacgtccagctgccgcgccagcgcctggggccgccgggatgccacgccctgctccaaggctggcccatgctcgcagtactctgctcgaacccggagccggatgtctgcaggggaaggagggatttgtcagggagggggccaacactagacacacttatggggaacgccacccttcctccctcc

SEQ ID NO: 147 - DNA, 500 bp, Homo sapiens
tgatgcccggcccccaggggggcagaggcgccgccaccatgagcctgggcaagctctcgcctgtgggctgggtgtccagttcacagggaaagaggcggctgactgcagacatgatcagccacccactcggggacttccgccacaccatgcatgtgggccgtggcggggatgtcttcggggacacgtccttcctcagcaaccacggtggcagctccgggagcacccatcgctcaccccgcagcttcctggccaagaagctgcagctggtgcggagggtgggggcgcccccccggaggatggcatctccccctgcaccctccccggctccaccggccatctcccccatcatcaagaacgccatctccctgccccagctcaaccaggccgcctacgacagcctcgtggttggcaagctcagcttcgacagcagccccaccagctccacggacggccactccagctacggtgagggcctgggccatcttggcccacttttcaga

SEQ ID NO: 148 - DNA, 110 bp, Homo sapiens
tttgggccacgaggcaagttcaaagcgggagacttttgttttataaaatgatggtgagcagctccggttttatgtcaaacatcagggtttcgtgcaggatataaacattt

SEQ ID NO: 149 - DNA, 800 bp, Homo sapiens
tgcctgagcgcagagcggctgctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcagggaggcagggaggctgcagagtcagagtcgcgggctgcgccctgggcagaggccgccctcgctccacgcaacacctgctgctgccaccgcgccgcgatgagccgcgtggtctcgctgctgctgggcgccgcgctgctctgcggccacggagccttctgccgccgcgtggtcagcggtgagtcaggggccgtctccccgaagaacgagcggggagaggggaccacggggcgcggcgggcagcctgttctcgggcggaggctctccggggcgttggaaacctgcatggtgtaaggacccgggaggaggcggggagaaattgattgtgctgttctcctccctctcttctctaacacacacgcagaaaagtttaaatttttgtgaagcgcttgcttacgtagctgcggagcgagcctctgcttcattacgagcggcatagcctttttcaggagtgatttccactttctttgtgagagagttgaccacac

SEQ ID NO: 150 - DNA, 600 bp, Homo sapiens
ttcaatttacactcgcacacgcgggtacgtgggtgttcggggtagggcactgatctggggaaggtctcccccccgcgacccaactcatctttgcacatttgcagtcctccctcggtgcactcctggcggggatctggccagtgcagcgcactgggaccgagggcagagcccgcggagtgaggccaggagagacttcaggcctctaaggacacagctgaggctaaggctgagttgaacgcagcccctcccgcggctcgtcccctctccagtgtctctcccgtaaggtgccgctcccaacagcaatgggtcgagatgtagaggaaacactctgtacgttatttttccgcccaccctttagcgcctgaggagacagacagtgtagactttagggtacaattgcttcccctctgtcgcggcggggtggggagcgtgggaaggggacagccgcgcaaggggccagcctgctccaggtttgagcgagagagggagaaggaggtccacggagagacaagaatctccctcctcccacgcccaaaaggaataagctgcggggcacaccgcccgcctccagatcccccattcacgttgagccggggcgcg

SEQ ID NO: 151 - DNA, 1400 bp, Homo sapiens
gcctgaagaccatttcttcctctcttagggacctgctggtctccagctgattcggtccaggaggaaaaacctcccacttgctcctctcgggctccctgcaaggagagagtagagacactcctgccacccagttgcaagaagtcgccacttccccctccagccgactgaaagttcgggcgacgtctgggccgtcatttgaaggcgtttccttttctttaagaacaaaggttggagcccaagccttgcggcgcggtgcaggaaagtacacggcgtgtgttgagagaaaaaaaatacacacacgcaatgacccacgagaaagggaaaggggaaaacaccaactacccgggcgctgggctttttcgacttttcctttaaaaagaaaaaagtttttcaagctgtaggttccaagaacaggcaggaggggggagaagggggggggggttgcagaaaaggcgcctggtcggttatgagtcacaagtgagttataaaagggtcgcacgttcgcaggcgcgggcttcctgtgcgcggccgagcccgggcccagcgccgcctgcagcctcgggaagggagcggatagcggagccccgagccgcccgcagagcaagcgcggggaaccaaggagacgctcctggcactgcaggtacgccgacttcagtctcgcgctcccgcccgcctttcctctcttgaacgtggcagggacgccgggggacttcggtgcgagggtcaccgccgggttaactggcgaggcaaggcgggggcagcgcgcacgtggccgtggagcccggcctggtcccgcgcgcgcctgcgggtgccccctggggactcagtggtgtcgcctcgcccgggaccagagattgcgctggatggattcccgcgggcagaggcagggggaaggaggggtgttcgaaacctaatacttgagcttctttgcaaagtttccttggatggttggggacgtacctgtataatggccctggaccagcttccctgttggagtggccagagaagtgtgtaaaacacactagaggggcagggtggaaaaagagactgccttcaaaacttgtatcttttcgatttcattttgaaaaataactacaaatctattttaattttacaaagttagactcatagcattttagatatcaatgtcttcatttaacagaagtgaagatggagcaaacgctcaatcagcgtctgtatttattcgctcctgttgtgccagggtgcgtttttgccgagcggttgcctttctttactcacaaaacccccttgatgtctgtcctccacgttttacgagggagagccggatcttttgaagtttgtatcatctaaagcaggtatattgggatgactatggatagaatttaacctgaaaacactgaagttgacagctgacaaag

SEQ ID NO: 152 - DNA, 250 bp, Homo sapiens
tgcttcaaccggaaatgtggttgaattacccttacagtgaacctgatcagtggtaacaggagatgctagaacaggaaaagacaagtttcccctttcctccctatcccatcaattactttgaggtgtattttttctttgcaacccctccagagaagtcggcaatgtttaacgagcatgcctgccaagtggcttgccttatacctcattatgaagtgatactcagggccactaacacatcgcacagcattgc

SEQ ID NO: 153 - DNA, 500 bp, Homo sapiens
tatgattccctcgatttccctcaatcttaaccattgtggatcacagcaggagggccagaaagtgagcttcagcctggcaccgggacctcagcctctcccttaaactttccctaatcctcggagctagtgttactcaagtgactccacagtgttgcccgatcccttcagacatggccttgatgatctccaaaactcatgctacctttgccagcctaaagcatccactctgtgccccaaaacgtgaatgtcaaatacccttcaaggcagaaggctatttctatttttgtttgtttctgtttaaggcaacaatcaccaacatttggtacacatgagccatcctgtgaaacatcaaggcgcttcgttggcagcaagtcaacttcggtttcagaagaaagctgcactatttcctgaggttagaggtttaaaccaaaacaagacaaccacattttaaccccaaatctgccgactgagggtaaccatgatccttccttcacagcacc

SEQ ID NO: 154 - DNA, 150 bp, Homo sapiens
tactaaatcaacccaaacccgagaacccggtcatggagaaataaatgatagtaatctatgctgttcatctgttccatcactcactcactctcttgctgaacaagaaagggccacccatgtagcaaaccacatgtaaagagccgggaagac

SEQ ID NO: 155 - DNA, 300 bp, Homo sapiens
tattattttgttcaaagtagacgggtatactaacatctgtgggcaagtttaccacacgccacttaaaacaggctaacagggtcatatgccaaaacgttcaggtttgcatttttgaaaagctcagagatctgacagatgtgttccggccgcgatttaacatgcggctccagtgagaaggaagcagatatgacaaatggttcacttatttcagaactaaaaccccagaggagcagcctgagccaaaaagggaagtgatcaatggaaaagacggtcgaatctgctcacaggcaaggcaagggg

SEQ ID NO: 156 - DNA, 400 bp, Homo sapiens
gcaggggtgactggtcctctctctctgcacctcgcaggatttctctggaagatctgagcccgagcgtcgtgctgcacatgaccgagaagctgggttacaagaacagcgacgtgatcaacactgtgctctccaaccgcgcctgccacatcctggccatctacttcctcttaaacaagaaactggagcgctatttgtcaggggtaagtgcgaccctagaggcgatcgtctctgctgtctgtggaaaaaagagctcctacacccaaagtgcttctcagttgctgacacttgatccaagctgctaatttaatctaatgtgaggctgagttttctgaatgtgggataaagtcgtagctaaacctgcttctcagggagtgccttttatctgcaatgtttttcaaat

SEQ ID NO: 157 - DNA, 10000 bp, Homo sapiens
gtctttcccgcccccttgtctaaactcaaaaccgagtccgggcgcgccttgcagggcgcccgagctctgcagcggcgttgcgggctgaacccatccggcacaaactgcgggccactggcccctcacacctgggagtttgcggcgctggcctgcagcccggggcccacgtggcggaagctttcccgggcgcgcgctgcgcagccccgcggggccggggagacaccgctcgggagtcctccgctcggctgcagaatctttatcagctgcactttaccgcagccctggctaggacgctaggcggtggagcgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctggatgctacaggggctcaaggaggggtggaggggccttcccaggccaacccctgaacggcttggacaagatgctcagatggacgggaggaacggcgtgtgggatgggggagctggaggcgggtgggtgggggggggaggatggggaaagcgctggcccacccagtgtgggaggggtagaggaaaagcccgcaggggccaggttgggaccccgtaggccgggttagagggcttggacttgatcctgacaggcgacagggagacatattgctacttattatgtgcacagtggccagatctctaaagaaaacaccatcccccacccccaccccccatatagtaaaccaggtggtccgcccagtgctcccagggaggtgatgggaaatcccactccataccctgcggtgaggggttccatgccctccacgtgtgcaactactccgggcccagggaaacactgggccccatccggtaacccccggcccagtcgggtttcccagttcacattataaccaaacggtcttgccagctagacagacagacacccctgacctgtttaccctgatcctctgctctcaggattaatcacaacttgtcgaagggggtggcttccagtggggtggaccgctctgtcaatgccagcgtgtgtctagcatctcctggggtgggggtgtggggaagggaggtgtaggatgaagccctagaagcctcaggcaattgtgatccggtgggctggatactgaagcccacccctgccttgacctcaattttcagtatcttcatctgtaaaatgggaacaacctgccttcctcctagccctaaaggggctgctgtcaagattggctgagatagctgtttgcaagctgagctcaatgaaagttcattgtgtccccctcagtcctatcccaatatcgtctcactgcaaaggtggggggcagcttaacttcaagggcacttcaaggatagccaggtggctgtcagcccagctttccaggatgggagcaggatcttgacagaagggttgactgggaggggcagttgctggtttgggcttcgttaggttgcatttttgtttgttgtcctttcatttccctggggcagcaccccttcctgcaagctccaggccttcctctggaatgctcctagagcccaacctctgctggtgcctgagcttaagccaggccagctaaggggatcctggattcacacggcctcacagtcactcagattgttagcagaagacaaaaattacaaggggagggcgtcatgtgattcttacacaccctccaaatccagcagacaccttggaagccacaggtagcttcaagaaacccattttacggatgagaacctgagatggagaaaggacaactggagatctctgagtctctgagcccacactccctacctccctgcacctccaggcactctgctggcaggatcttgggcaaatgcccacagctctctgagagtcagttttcctgtctgtaaaatgggagtcataccttcctcctatggccggtgagagactaaattaaactatgtctgtcaagacacctgaaactcctggcacaatttaggttgccttcaagtggtcacagttgtcattaggtggaagtcaacaccccaatcattgtaaaggtgcccatataccccaagatccagattacagctctcacagtttattatatacagcgaaaaaacacataacacacctttgcccacatttacatgtattttacggaccatgtttcacatcagtccgcatgcacatctgcacgtgtgtgcattcggcagtatttaccaagcacctgccaagtgccagggcctgtcctccgcacccggcgtgaactgtcctggaccagtcccgggagccgcggttctgaccagccgtgctgaccctggacgactccatgagctgttttgtgagaaagacacgccatttgtttgcagagttctgacttctgaggggtcatgtagcacatgtttggtagccaaacgctgtcattcacgaccaggagcgatggctgcaatgcctttttctttgctttgctttccggtgccgggagccttgcctcccgccgccacccctggtcagctctgcgcaagaacgtcgttctgtttggcagccaggccgagacgcagcctgaatgtgagcaggaactcggagaagggaagggagagaatcagaaagaaggcccgggagggacccgggaagcagtgggaggtctgcgccctggagccccgcgagagcccgccggtttggcacgggctcctcccgggccgcccggcggtccaacaaaggccggccccgacacgcacccggtcttttgtgggagagaaacacaaagaagagggaaaaacacggaggaggccaacagcaccaggacgcgggggccaaccaggaactcccggagccggggcccattagcctctgcaaatgagcactccattccccaggaaggggccccagctgcgcgcgctggtgggaaccgcagtgcctgggacccgcccaggtcgcccaccccgggcgccgggcgcaggacccggacaagtcctggggacgcctccaggacgcaccagggcaagcttgggcaccgggatctaatttctagttattcctgggacggggtggggaggcataggagacacaccgagaggtactcagcatccgattggcaccagggccaagggagcccaggggcgacacagacctccccgacctcccaagctactccggcgacgggaggatgttgagggaagcctgccaggtgaagaaggggccagcagcagcacagagcttccgactttgccttccaggctctagactcgcgccatgccaagacgggcccctcgactttcacccctgactcccaactccagccactggaccgagcgcgcaaagaacctgagaccgcttgctctcaccgccgcaagtcggtcgcaggacagacaccagtgggcagcaacaaaaaaagaaaccgggttccgggacacgtgccggcggctggactaacctcagcggctgcaaccaaggagcgcgcacgttgcgcctgctggtgtttattagctacactggcaggcgcacaactccgcgccccgactggtggccccacagcgcgcaccacacatggcctcgctgctgttggcggggtaggcccgaaggaggcatctacaaatgcccgagccctttctgatccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaacaaatgtctgaattcgaaatgtatgggtgtgagaaattcagctcggggaagagattagggactgggggagacaggtggctgcctgtactataaggaaccgccaacgccagcatctgtagtccaagcagggctgctctgtaaaggcttagcaattttttctgtaggcttgctgcacacggtctctggcttttcccatctgtaaaatgggtgaatgcatccgtacctcagctacctccgtgaggtgcttctccagttcgggcttaattcctcatcgtcaagagttttcaggtttcagagccagcctgcaatcggtaaaacatgtcccaacgcggtcgcgagtggttccatctcgctgtctggcccacagcgtggagaagccttgcccaggcctgaaacttctctttgcagttccagaaagcaggcgactgggacggaaggctctttgctaaccttttacagcggagccctgcttggactacagatgccagcgttgcccctgccccaaggcgtgtggtgatcacaaagacgacactgaaaatacttactatcatccggctcccctgctaataaatggaggggtgtttaactacaggcacgaccctgcccttgtgctagcgcggttaccgtgcggaaataactcgtccctgtacccacaccatcctcaacctaaaggagagttgtgaattctttcaaaacactcttctggagtccgtcccctccctccttgcccgccctctacccctcaagtccctgcccccagctgggggcgctaccggctgccgtcggagctgcagccacggccatctcctagacgcgcgagtagagcaccaagatagtggggactttgtgcctgggcatcgtttacatttggggcgccaaatgcccacgtgttgatgaaaccagtgagatgggaacaggcggcgggaaaccagacagaggaagagctagggaggagaccccagccccggatcctgggtcgccagggttttccgcgcgcatcccaaaaggtgcggctgcgtggggcatcaggttagtttgttagactctgcagagtctccaaaccatcccatcccccaacctgactctgtggtggccgtattttttacagaaatttgaccacgttccctttctcccttggtcccaagcgcgctcagccctccctccatcccccttgagccgcccttctcctccccctcgcctcctcgggtccctcctccagtccctccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagtaaagtcgggggatttccatccgtgtgccaccccgaaaaggggttcaggacgcgataccttgggaccggatttggggatcgttcccccagtttggcactagagacacacatgcattatctttcaaacatgttccgggcaaatcctccgggtctttttcacaacttgcttgtccttatttttattttctgacgcctaacccggaactgcctttctcttcagttgagtattgagctcctttataagcagacatttccttcccggagcatcggactttgggacttgcagggtgagggctgcgcctttggctgggggtctgggctctcaggagtcctctactgctcgatttttagatttttatttcctttctgctcagaggcggtctcccgtcaccaccttccccctgcgggtttccttggcttcagctgcggacctggattctgcggagccgtagcgttcccagcaaagcgcttggggagtgcttggtgcagaatctactaacccttccattccttttcagccatctccactaccctcccccagcggccacccccgccttgagctgcaaaggatcaggtgctccgcacctctggaggagcactggcagcgctttggcctctgtgctctttcct

SEQ ID NO: 158 - DNA, 100 bp, Homo sapiens
tttttaatgctcagagaagttcgtattactgattcgggaacactgagtttttcagctcctgtaaaactattttcaggtttattttcaagtacattcttta

SEQ ID NO: 159 - DNA, 400 bp, Homo sapiens
caccctagaggcaaggacggggtctgtgtcaagaggcttcccagagaagtgaaaactctgcaggtgcagccgctgggagagcatcaagaagggcagggtggaggggcagggggcgaagggagggggtgaagcccgcaccctacccccacatgaaactgattccactaccccatctctgcaagcgtccagaggcagagaggccaacatttcggggacagcttggaggcgggagatttaggcagggctccttaaacttttatgtgcatgaaaatcaggccaatcacggggctcttgagcaaatggggacgatgattcagcaggtctgggctgaggcctcagattctgcacttctaacaagttcccaggtggtagtgatgctgccagtccaaagaccacactg

SEQ ID NO: 160 - DNA, 5000 bp, Homo sapiens
tgcttcagtggggtaaacttgaaccgctgagaagacaagcagggagtcggtctcgctgagatttttacctgtggttctaggaacgcagaggcatgtgagtgttcaggctttgcatagaccactaagccacttctaagaacaaggctacctgagccattttgcaaaaatatgtacgtgccgaggcttttcctccccacacctacctcaactctttctgccgacacactgcacttttcaagggaacccaagtttgggttcggcaagaattgtacgttgcacaccgtgtgtgataattccagggaatttcaatcgcatcttgtcttccttcctaagcaaattcggtgggaacctggtgtggtgtgatagaaaaagccccgagttctctgtggtagaccacatcaatttcatgtgccagtctctcagactccggcttgcctctctcaaggaagggaacaatggtttgcttggcttcactcctctctttccccccaatttccacatgggtatctggctaaaaatgagttacaggtttccttctgtgagaattgcatggactgataaagtaccatcccaggaagaaaacaaagatgctgtcttccctttcggctcacagttgccgttggggagggaacacacgctgtaaattataggcagccagaagtgaccgcattgaccactgcgagtggcccagctatggcaacaggctgagaactctgggggagagccatttgttggcagggatggtgattcttctagcatcaagctctaagatgatgaccaaacggtatcaaaagaaatgatattttgctacctctccggcttgggtgaatgatgtggacagttaacctggacaatttaaacctttatgttgatggatcacttggatgaaattaaccaggaaattgccaagatttcacttggccctctgacatcaaatctcaatattatattaccaaattagagattctaaagaaccctgagttcctttcactgaaaggaaggagtggaaaaacctttccagatgatcccttttgagtcttggtgcgagctcaggccctccctacactgcctccgtgaaagctaaccgacccttgttcctaacctagcgcaggtcagctgagtgtccatcgggcacaggagccctgggcttgtccgggagatagccagactcctgctatttcctgatgtctgcatagctcagcgtgtccctcaccatctttgccgttggccagtaaggagagccccaggggccagcactgcacactgaaacccaacctattgctcaatggaatgcttaaaaatttcctgaatctgccttcctgagttgataaaataggaaacaatacacgttctgagggggtactgaaagcagagtaaagccaggaagatcttttttttctgttattctatacaaatattgcttcctctgcttgttagcagcccagaggaaatgcagccagggagccgtttgcagcttttcaccagtggccggtgtctctgtgttaccaaccaaacgacgctgcaagactagtgactaacgcacgtctgcatgattcaacttcactaaaattccctctgctgccagtaaagaagcacttgaaaactctttaatttgaaacttgagcttggttaatgacttgttttcttctctttctctttaacttctctcttgccatctccaacacacacacacacacacacacacacacacacacacacacacacacactctctctctctctctctctctctctctctctctctcatcaagttttttaatttcagggacccggaaacatacagccccgtgcattcacaatagcatttgctgtgataaagtggccggcaagccctctgcattcccctgctcacttagctgtatgaataaataatgagtcacagatacaatttgggtgctcaagagagtttgtagccagaaaattaattattctcccatcccagcccactccatctcagctttgccaaaccatcaagatacactttgcaggcactggtcagagtgcgtgccccgacgcacacggcaatgcctttgagacattttatgttattatttttgtttgtttaagcacagccctcttttaccacgaaagatacacaagacgcacatgcacacacatactcacacactcacagctcaaccacagctttgtccatttcaagaggctggtttcaaaaatggagacaggttttccaccctggctgttcctattcataagcctgtaatctaacgacttaagctgcgagaatgcttaactcgggaaacttctctattgcccttttccagagagacctcggtatgccacaatttgcttcctttctctcttgaaagatgctggttgtctctttgcattgaggctacaaggaaaaacacagcacagccccatgctgatgattttaacctaaccaagtctgtcagtctcctgtactctctgccttatagagacagctgccttgccactttggccctgaagtccccaggctggtgcaaggctatctgagagcctccgcctcctgccccacactggcaccagccctcctggctggctctgtgcatgtgcctgctaagccccagggcaggctgcattctgggccacacagcatgccgagttaaggataactcagacacaggcattccgggcaagggacagcaaaataaaacccagggagcttcgtgcaagcttcataatctctaagcctttaaacaagaccagcacaacttactcgcacttgacaaagttctcacgcaccgactgaacactccaacagcataactaagtatttattaaaacatttctgaagagcttccatctgattagtaagtaatccaatagacttgtaatcatatgcctcagtttgaattcctctcacaaacaagacagggaactggcaggcaccgaggcatctctgcaccgaggtgaaacaagctgccatttcattacaggcaaagctgagcaaaagtagatattacaagaccagcatgtactcacctctcatgaagcactgtgggtacgaaggaaatgactcaaatatgctgtctgaagccatcgcttcctcctgaaaatgcaccctcttctgaaggcgggggactcaatgatttcttttaccttcggagcgaaaaccaagacaggtcactgtttcagcctcacccctctagccctacatctctctttcttctcccctctgctggatacctctgggactccccaagccctattaaaaaatgcacctttgtaaaaacaaatattcaaattgttaaagattaaaaaaaaaaaaaaagccagcgccgccttggctgtgggttggtgatgctcaccacgctgcgaaaccctgtggtttgcattcagtgtgattcgtcctgcctgctgaccactatgctgggttcagacttctgacactgccaggctacccaacttgtggttctgtggttgtttatgaggcccaaagaagttttcacacaacccaaattacaaatttaactgttcccctttccacagcccatctcaattggttcttgccaatcatgtgacttaagtgatgtcaatttttttttttcttttctgagcaatgcccttccttccctccacctgccctcccccaggctgtgcaagaaaatagccgagtagactttgcaagagggggggatgtagaaaaaagtgactcagtcacttattatatctcaatggtctttgctgatttagtacaactcggctcctgttgttatttgtggtttttggaactactgattattttgataaagatttcattgctgcttattcaatagtaattcaacgctggcatcaagccgctgctccgacaggatgtggatcccatcatttaaaatgctaggcatcagctccgggagagttaagtccttggtaacgtctatcatggcataagtgaaactataaaagggaaaaataaataaaaagaaatgttttggtgagagtctgacccctacaacgggctggcaactcacaggtattttaaagcctgggaaagggaaagaattttacttttgaaataaaaggactgttttaatgaaaccaaaattatgtggttttattccccctaaatggacaactttagtatgtatctctttcagtaaagagataaaatcatagtacagtcttaacacacacacacacacacacacacacacacacacacacacaaattaggaagctaaaggaaaacaaagcagagagaatttctgtatttgggacaaagcagtggttactctgcagatgtttatttgtattgtcacttgggaaagctccctgtattgcctttctctagttcaattcaaatcaataggctaatttacacctgtaggtaaaactacactttgagcacatgaggatgccacaatagaaggggaaccaggaggagacacttctcctggggctgactaatgaatattatatagcgcgtcctctaccttagaaagacatgcctgtttgaagatgctaaaaacaggataattttgtaagtgggcaaaccactgtggtcacacgtatttcattttccggccccactggctttacctgctgacaactaaaacgtcattttgttttgtagttccaagatgaagaaaggcttattttcctgatttactaccttattcatttggctctgctctgcctacatccgccatagcactctgcgcacgtgaaatttcgacacatagggtcaagagaacctgtgtgatgatgggttgtaaatgccagtcctggattctaagctgcagtagccagcacaggcacttcagaaaggctgaactcccacaacactccctcggttttccctcatccacttaatttcacacacacaaagacccacaacgatagtagcttccatggcacaagtctttcaaaaggaacagacacaatttttacttactcctgttttgactaaagcaggaattgaaactcaacagaccgctttctcttacacttgtgagaagttagctggccacatgt

SEQ ID NO: 161 - DNA, 500 bp, Homo sapiens
agggaaaagagataacgaaagaaagaaagaaaaaaaaaagggccggcaatttcatgtacatttgttttggcattcgctgaattctagagatgaaaacaatctcctgcttttaattcagtccacgtgcaacaaagttgtacgttgggagatctggcttttaataagaacgattaacaagcgtttttgatcacaggaagttgagaagagtcgctgcttctaagaatacaataaacattgactagcagttagacggtccatctttctctatcagccgtttagcagcctctactttgatttggggcaaatgcgagatgggaccaggagagagctccccacacccccaccaccacgtgggcagtggttctgttccagagcgccttccttcctgtccagggaggcaggctgctgaggccgtttctgggcaagaggccattgtcgggatatttgctttagatagcttgcagctgggctgagtgggtgtttcattcagactcaacaca

SEQ ID NO: 162 - DNA, 700 bp, Homo sapiens
agcctggcgcacccgccctaatttgagtcagggaccctaggcgcctgcagctccggttcgggttgagtgcctcctgtcaggatgtgaagctgctgtcccccccgggggcctccagcactgctgaggactcagcagtcagcctctcctcccacttgggctcatttacagagagcatctccaggaatcagtcatggggaaaggggaaacgcggagtgacaacacaacacgtagaaagttctctgccgccttggtcaggcttgtcagcctcacagcccatcctgctcctgcgggaggaaaagtgagcagaactcagcccggagatgagccgcaggccggcagcccctgcctctgccctgcttgttgtgactgcaatgcaaggctctctgtaggtgcgggggattcgggttaaatgggtctccagtggtccagcgctcccagcaaaggccgaccacaagaattagcgggctagttatttaccataaccatatacaaaaccacaagcatcagcgttccctcaaatacatccgagacgctgtatatctctttattaaagcctgtcagggtttgttattgcacagcttggccttgaaccccaactaaaccaggctgcttgagcaaagaaccaagcaatgcaagcattcaggcaggaccattataaccctgaggccaaaggcagaagcagggagaggagacgtcttcc

SEQ ID NO: 163 - DNA, 500 bp, Homo sapiens
agaccagcctcggtcttcggcctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccc

SEQ ID NO: 164 - DNA, 17000 bp, Homo sapiens
cacgcgccccggcctggctggaggggccaacccagcggggcccgcctgcccgccggcctttctgtaactttctctctttaaacttccaatgaatgaacgtgcctcttcttacggatttgtttagattagggaatagattcctcgctgatagcgttgctttgcaaataagacctcctatattattcaaaccaaacgagtttgtgtctttaaaggactatagcagccccattctatgttaagggttggctattacaattattatatgcttagggaaaaaatgtaagccccgtagtttgtgcttttcttgatgtacagaaaggtttatcttaggtggataggttttgttttgtttcttaaatgggatttttttggttcgtgtctttgaagggctgtttcgcgacgtcattaatgaactaatcggttttcagatttcaagacggtgtgtaattgatgtaaccactgaggaatttcagtgcacaccagactaagactcttccagcgcaggggattccagatgcttcttgggccctctggaagccatggggatgtttccagaccgaaaggagggctttgctggggagcagatgtgctgcctctccccgacccaggattttgaggccatgtttccgttaatctggaccgagagccctctgggagagggaggcaggtcgtagggggcgggggtgagggggagcgagatgaggtcgtcgctggacgctgggctcccttgtcgttgtccttttccccagaatccatggtcaggcctagggagccacccctgggtgctcgagatgagtccccaccctcactgaaggtcggtcactggatgtttgtgtgcatcgtaaggggcccaccgaagtcccgaagccttctcagggaccagcgagaaagaggagcaggcttgggagacagggaaggaaaatgcaggggaaagggctcacccctcgaccccaggtaaaattagaaggaacgtgtggcaacccaggtgcagctttggtcgctcgctcaaggactttgctagtcactaccattaattaattaatcactatcattaactaccaaggacaccgtttttattcccctaaaagcgtcaccttgaggggaatggagaattgggcagcagctatgcaaatcctgggacaggagacactgcctgaggaccctctctcactcccaatcccagaacccgaagttatccccgacaaccaagtccaagcacatgaaccaagacgatcagcttcaggcagctccttacccccacaagcggcccaggaggtgggcattatcccccacccctgggatttctccatccctccctcttctctcctgcgggagagagagctgtggtcacccagttgggcgcgatggctctggactaatggggtctctagacccagggcacaaaggccaatctgccaggggttactgcatgtaatgagataatcagacatgttgaccaacctaaaagaaaagactctcccagggagtaactcccagtgaaataatttattaaaaaaagcaaaaaagagacataaatttctctctactacttgaggaaacagcaaacagaacgaattagggtcttggcctctgcaggaataaattatttccgacttggtctggatacctgtaattatttgtaagctgtgggtagtaatactgtaattgtcccccggtcctttctggaagtagcaatgaccccaaggacaattggtgacgtctccacagggtttacacatggaaaggagtgaaaaatcgaggaattctttcagatagcccagaccaaaaatcctctcagccatgaaaaggtcatatatgtgatgctgggccaagcggacttttctggagtaaccatatcataactgattgcggatgtagacaagagcgtataaaccaaataggcttgaatcaacgcagtcctggattttctgttgcctctgcttgctggggcagtggaagttcttaaactccacttcagaggttggaaattcttccccctcccccacctccttagtgacaaggtctctgatctcctgctgccactgcaatagcctctcccatcccgcggggaacggccggagttcttcccttgatctctcccgagtcggcttccgctggggatggatcgcaggtaggcgccggcgcggcctggggaagaacagttgcggagcatctgaagcggaaaatccaagcagatgtgaggcgatccgggcccgcctcgttcctcttggggcctgaatttcttccagataagtttcctaatggaacatttctaagaggtggggtacgaggcggcttgctcgcacgcgcagtgggacagactgcgggtggggacgtactgagaggtccggacctcaatgcgtccgacccgtctccacaccgcccttttccagcccccagtctcctttcattccctactcttcaggctcctttggggccagtgggtgaaccgccatttagaacggtgcctcggactcgggggtcgtgcgctccatctctgcctcccccctggggcccgcgaggctggtccgggctttctgagctgggcgttcggctttaggcccaatacctggaccaggaatttcttctccccgcgccagaagggaaagacataggaggtgtcccaatctgcggtcaccgccgatgctcctgaccactctagtgagcacctgcccggtacttttccattccaacagagcttccagcttcatactaactatcccacatacggcctgtgggtattagctctaagtgtccttttccgagggcccgaggctccccctccagcagggagagctccgggacggcccccaccaagggttgggtttcttccttcacaattccacagaggcatccctgtccttcctacctgggaaacctcgaggtgcggtgcccgtgtacttctggtactttgcgtggtgccatcagggaccccagagccacagctgcgtgtgtgtgtggatgtgtgtgtgtgtgtgcgcgcgcgcgcgtgtacggcgaaaggatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccccttggagctccttctcccagaggcccggagccggcagctgtcagcgcagccaggagcgggatcctgggcgcggaggtgggtccgactcgccaggcttgggcattggagacccgcgccgctagcccatggccctctgctcaagccgctgcaacaggaaagcgctcctggatccgaaaccccaaaggaaagcgctgttactctgtgcgtccggctcgcgtggcgtcgcggtttcggagcaccaagcctgcgagccctggccacgatgtggactccgcaaggggctagggacaggcagggggagagcccgggtttgcgcacaccttccagcccctggagggagcctgctcggcttcgaacgccttcgaacttttgaccttcaaaggagtccctggaaaaggtcaggagcgcctgctgcaggcacggttgccgaaggccaggccttcctggcgcaggggagggccaggggagggaagcggatactcagtcgctgtccgacggcgagttttcggagcagcaggctcatgatcccgggccagtggcgagagcagtgacaccgagaacccaaatctccgcgcccccatccgcggcccggtgtcctcccggcccctgctgacctccaggtcacgcaccccactgctccacggctctgcagcctgtggcacacggccgagagtccccacatgatctcgacgccaaggtaaggaattgccctgcgtcctctgagcctgtctctggcctggggggccgggaaagctgcactcctggaagaggtggggttatgtgaccgccgctgcaggggtgcgcggaggactcctgggccgcacacccatttccaggctgcgggagccggacaggggagggcagaggggggacaaaaggactctttaggtccaaaatgaccctgaaggagagtccagaatgcccagtggccgcgtctgcaacggagtcttctttctccaattgccttctgccccatcaccatgggccccacctgcgccacctgcgcccaccctgtgaccctggctcagcgaccttggcccttaatcgcccaacgccgattcctcaaaattccggctgcgctgaatcgggctgcttttgccgccgccccggcagttgggccctgtttccgccggcgccctgggagaggcctcaccactcggctgggctccctggcccctcccttcccctggcctgagcgcccctgcggcctcccgctcctcctgagaaggcgacaatctctttgcaccttagtgtttcgaggacagaaagggcagaagggtcacttcggagccactcgcgccgttttcacgtgtgtgtgtaatggggggaggggggctcccggctttccccttttcagctcttggacctgcaacaccgggagggcgaggacgcgggaccagcgcaccctcggaaggctcgatcctccccggcagggcgcctggccaacgagtcgcgccgcctcctctcggccgcgcctgctggtgaccttcccgagagccacaggggcggcctcggcacccctccttccctcgccctccctgccgcccatcctagctccggggtccggcgaccggcgctcaggagcgggtccccgcggcgcgccgtgtgcactcaccgcgacttccccgaacccgggagcgcgcgggtctctcccgggagagtccctggaggcagcgacgcggaggcgcgcctgtgactccagggccgcggcggggtcggaggcaagattcgccgcccccgcccccgccgcggtccctcccccctcccgctcccccctccgggacccaggcggccagtgctccgcccgaaggcgggtctgccataaacaaacgcggctcggccgcacgtggacagcggaggtgctgcgcctagccacacatcgcgggctccggcgctgcgtctccaggcacagggagccgccaggaagggcaggagagcgcgcccgggccagggcccggccccagccgcctgcgactcgctcccctccgctgggctcccgctccatggctccgcggccaccgccgcccctgtcgccctccggtccggaggggccttgccgcagccggttcgagcactcgacgaaggagtaagcagcgcctccgcctccgcgccggccgcccccaccccccaggaaggccgaggcaggagaggcaggagggaggaaacaggagcgagcaggaacggggctccggttgctgcaggacggtccagcccggaggaggctgcgctccgggcagcggcgggcggcgccgccgggttgctcggagctcaggcccggcggctgcggggaggcgtctcggaaccccgggaggccccccgcacctgcccgcggcccactccgcggactcacctggctcccggctcccccttccccatccccgccgccgcagcccgagcggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtgaggcctcaggtgggcggccggggacgctggggagcccggcggccccggcccaggcgggaagcgcaagccagcccgcccagaggggttgccgcggcctggcgtccagagctggggcgtctgagggaggttgcgtgagggtcttcggcttcggcgctggcttggggcgaggggccagggccttggcggcccaggcgaccaaaccctctcctggtccagggctgggtgagggcgaattacgaattgttccaggggcaggcagtcccccagcccgcacggccagcgagttctttctggttttgttctttctccctttcctccttccttccttcgccagtgcattctggtttggtttggatttttttctctctttctttcctttctttctttctttctctttctttttctttctttcttcctctttctttcattctccccttccttccttccttggccccctctctccctccctccttccttccttcctttgccaatgcattggtttgttttctttccttttctgctttccttcctttctttggaagttcactctggttttgctttctttctttccccatcccttcctttctttatccctccttcccttcctccttttctttctacgattccctttatttttccttcattcctccctctttttgtctcttctggaggaggtgaaggagggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgccggacggtcggggcagagcaggcgacaggtgtccctaggccgcagggcgcttccatagcgccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgcggggcgctctcctctcgggcgcagcggtccttcagcccagggcaggttcctccctttcctactcggaacgtggcaaagataccccagtcccagcccctccagctgagagctgttgcccaaggtcgtcgctacttgtccgctcaatggtgaccccttggcagagaactagggatgattccactccggttgatgttttaggggaaattaaaagaacattcggttttctgagtctccttccggggaggcgtggtggtaactggtttgctgggaagagccgttccttaaccgcatgcaacaaagcaggtgtggaatccggacgagagggcactcactgccttctgccccctttggaaatagaaaaagccttcgaagcagcaatccaaagatcaaatgatttgcggtcaatgatttcaattaaaccagaaattagtaagggagggccgagaagacacggctgctcagaagctgttcgctgtttgagggatttcccggagagcctgttaaaagatgcgaagtggtgggtgtaccgctcagccacctttaaaccggctctgtgcgttctggctctggaaagcaagtctccaggcatttgggctcagaattgctgggccccgagtttgggcgggggtggtccttctgggggtcaggccttgagcagcttgcactggtggcaggtttgggagcagttgaggggcttcctgtgtgtcttttggagggggtgaccctggaagttggcactctggaagggagctgtttggccctagagttttggaaagggccctgaacctgttcggtccccctcggaaagggaagggagcagtggcttagtccctccctcctccattcgtgcaatgcctggggtaggggtagacctggagccggtggactcatatccttggaattcgtcaggacagctgctccggggccttggccctcagtcagtctggggctgaggagtagggaagctgggaacttggggcagaggaagaagatgcgtttagaaagacctccattatgcaaactggagtccatttatgcaaactggtcacccttccagtagctccaaagagtggcagtggagtggcatcttgattgatttaacctcttctcaggggacctgggtctgcgagggaggatatggctgcggggttggaataggatctgtctgagctgccagggtcagggtggtggccctagggaggttttagggccagggtggtcccgggctgtggcaggggctctcagatcgcctcgggctctcagctgcaaggtgaaaaataccatgaggaattgatctgccaagggcggtcttgtctcaaagcaagtggattgctggggtaaagaatctagagaccagcttaggactctgggaggaagaaaaaaaaaaaaagaatagcatagtcctaaggaactgcaaggatcaccagattaacccttcatacctggggaaattaaggccagacatgacacaggcctttcccaaggctctgtagcaagggcaatagcaggccagttgctgccactgcggtcctgtggggcatgttctcactccactgcacccaggaggctgccagcctctgttccttttaacatagatctcctcagttgttaagacagaaagaggaactcagaggggtccctgtgtgcaaggcagagggagaccaccagaaccagggtaagcaccccacttggtagccagttcaaggacttggggatgttttcaacatttacagcgaggtttgaggccccattgtcatgcagcgctactcggccttggtctccttatctgtaaaatgggcccattagcaatgcacagggttgctgtgatgaagggtgaggtcccacaagcaaaagctgtgcagtgaggggggaatcctaagcattgttcctatgccattcaccccttcctgtgagctccccatattccctggctcaaaggagtcttgaatggcagggatggaggactcactgcctggactttgaagacccctgctttctgggtgaccaccttttcttccctttgacagtgaactaatacattggaggtagatagtgctgggaagaggacaggagaccacggctgactttggacatgggctcgaaattgataacttgatgagtcttggagggtggttaagataagctcggggctggggcagcgctgaggtctgatggtcagccagccctccccaaagtgtggccctccgttctggagataggggctttggaaactgcaaaagcgtcctggcaggccagctctggttgctccctggccatagctgctctgactacaggcagcaggacgcaggtcggcctctgcccatcggaggtcagaggcagggcctccagcaccagactcagcagtgccactgcaaacctggcacaacaggctggtcccaggactcagctcagcagtgaagttggaaaccaaggttgagtctccccatctccctttccccaacccgaaagacccaagatgggtgtgggtgaaagagggagaaagaattgctactccagaaactgtcatttgcccacacgaaacgaggtggggttcaaggtctgaactcttccagtgcctgggtgcctttgggtttaaattcagctgcaggtgcccccatcaccacttccacctgagcacaccacgagaagccaggttatcttagaaactgtttcccggaatcaaagcgacttgatttggagagttgggtgaggagaaactcacccctatacccctcagggcgtcagagatgtgaggcaattctctacctccgctggaaaaaatgcagatttattaaaggtcgactgtttagcagaacaacgtagattttttacaacgctttccccgtctctgctttgaagcctgccaggctgcagctggggatccaggagggaaagcccgcaggcgcagaggggacaatccgggaagtggtaaaggggacacccgggcacagggcctgtgctttcgttgcaggcgaggaagtggagcgcgcgctgcagattcagcgcggggctagaggaggggacctggatccctgaaccccggggcggaaagggagcctccgggcggctgtgggtgccgcgctcctcggagccagcagctgctggggcggcgtccgaactccccaggtctgcgcacggcaatgggggcaccgggccttctgtctgtcctcagaatacgtaggatacccgcgggcgacaagccgggccaggctaggagcctccttccctgcccctccccatcggccgcgggaggctttcttggggcgtccccacgaccacccccttctcacccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtgcttgcgtggagcagggagcggaagaggcagccggtcctcaccctcctctcccgccacgcacatatccttcttgacttcgaagtggtttgcaatccgaaagtgagaccttgagtcctcagatggccggcaacgcgccgaggtcacgctccccagaaacacccctctcccctcccctaccccagctccccctggggcgggtggtaattgggggaggagaggccgcaggcagggaaggggtgggaaagccagagagggaggcacaaagtgatggcagcccggcaaacactggggcttcgggctgggccgcgctcgtttaatcccacaaaaatcccattttggaggtgagaaatagaggttagaggtcgggcccttctggagatcagaccgaggagacgggcccagctggcgtcttaaagcaaggagggggagtcgggaggaggtgagacccctgcacccaggtggggctcccaaaccgttctggatttaccacactcccaggtccgattttccatggagggctggggttagggactggcaccttcttgttgttaaccgcatttgatattcacaagaaccctgtgaggagactttgtcaccgtttttagatgcctgaggttgccggaggggcagtgagagaatcgtctaacctggtgttcctaccacagtccaggccctgtgtcctgggctggacccacagcccctgccaccacccagaggaaggcgcgaagctggctgcctcctttacgggtctcccttaggtgccctcatgaagggggacggccacctcacagtgcaggaactatctccccgtttgctcccaaatagtcttcttggtgtggtgctgtctatggtctgtgacctgcatctggagttacccccaggaccagcttcggaagaggagggatcgcttggaggccgtgcagtgtgaggaacggcaggcagggtgtgggaccaacatgcacacactcgcaggtgctggggccagggaggaatgaggcgctggctccctttccctccatttctccctgggggtcccagcaacctggccatccctgacttccaacagcacagcgtccccacaggtcctgcagtgctctgcaggggtgcagggagctcccctccccccagccgcaacctcaccttcctcacccccacccctccggcaggaaaccacaggctgggttggggacccctggtgctccaagagagcagtgagtgctgggagccgctaaccccgaggcgcctagcacagactcttctcaccccttatttctgaaataaagcccttccttaggtccagatgaggaccacgtgctcagtgcctcactttcgtgggagtgtatatcactttacagtatcaagacaattttctttcgttacaaatctttatttagtctctgcgtttagaccaaagtagatttttatgggctgagtgaaaaaacctcgcccgcattggtttctgatggaacagctggcagcgccacggccccgggtggggtggcctagaggcaggggtgcttgggaggaacatctagcacccgaccacctccaccaggtgggaaagggacgtttgcaccaaatctccgccggcaaagcagaggctttggggaattacagaaaaactataatgatctaaaagagaacaagttatcttgaactgtgcgggtatttgaatcatacagaaaattgtcctgtgtgcccaatgcacttttgcatgtagagccagggccttcgaggaagctttcaggagatcccgggcagcggagtctggtctggagtttcatttccgtaggtgcagatttctccccaagtcttcccgccatgggctttgcaagaagccagggcccagaggccacgctcaccgttaacactgcacagggcaaaggtggctccaggacaactgcccaaccccaggaacgacccagcagcagagaaaaggacagctgccagggtgcctttgtcgctttttggaaatcagaattcctgggtccttagttaagtcttacttcaccaaatcccaggaccttcacattttggttcttgccattgctaacagttgtaaatgctgccgccacgaggcctgggaggaaggacccgctggtgagagcacagggagtgctgctgtgatcacggtggtgatgcggggtgagcgcgatttcccgggattaaaaagccaccgctgcccccgtggtggaggctgggggcccccgaataatgagctgtgattgtattcccgggatcgtgtatgtggaaattagccacctcctcagccaggataagcccctaattccttgagcccaggaggagaaattaaaggtcatccctttttaaattgaggaatagtggttttttttaacttttttttttttaggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgcacggcgactcctcgggaacccactcgtggctgcccgcttggaagggctttgcggccccgggaacgatctccaggatctccacggctggtcaggttccccgtccctcgtatcccgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctccggggaggttggggtgcaggcggtgcaccgaccctcgccatctggcgctgcagccaccagccacggcgcttagtggagggtctgcggccaggctcccggcggaaagattccggggagggctcgggggttgtcccagcccgcgctaagcgccgcagcctcgcccggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccggggatccctaattatgtgacaggagaccctttccagttcggcctgtggcccatccctctctcaccgccggcagattggagtctgctctcggggagcccccaggtaaacccctcacagggagaaggtttcggattggaaggaggaccgcgctcgtggggcgcctgtgagagctgggaagcccaaggggtagcgtgtagggggttttttatgcgggaggagctgcctcctgggcggcggggactttctgtctcagcctgtctgcctttgggaaaacaaggagttgccggagaagcagggaaagaaaggagggagggaaggagggtccttgggggaatatttgcgggtcaaatcgatatccccgtttggccacgagaatggcgatttcaaagcagattagattactttgtggcatttcaaataaaacggcaatttcagggccatgagcacgtgggcgacccgcgggagctgtgggcctggcaggctcgcacaggcgcccgggctgccggccgctgcggggatttctcccccagccttttctttttaacagagggcaaaggggcgacggcgagagcacagatggcggctgcggagccggggaggcggcggggagacgcgcgggactcgtggggagggctggcagggtgcaggggttccgcgtgacctgcccggctcccaggcatcgggctgggcgctgcagtttaccgatttgctttcgtccctcgtccaggtttaggagacgcgtggggacagccgagccgcgccgggcccctggacggcgtcgccaaggagctgggatcgcacttgctgcaggtagagcggcctcgccgggggaggagcgcagccgccgcaggctcccttcccaccccgccaccccagcctccaggcgtcccttccccaggagcgccaggcagatccagaggctgccgggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgccaggcgccagggctggagcagcagaaatgattgggctgctctgagctctgaagcattcggccgctgtgtgtgtgcaaggggcgcaaggacggagagacagcatcaataatacaatattaacaggagcacttgtccagagcttactgcaagccacattcagttccggaccttattgacttccccctcccatctagagtggattctggtttttcaatttgttttgttttgttttttgtttgtttgtttgtttttgagacggagtctcactctgtggcccaggctagagtgcaatggcgcgatctcggctcactccaacctccgcctcccgggttcaagcgattctcccgcttcagcctcccgagtagccaggattgcaggcacccgccatcatgcctggctaatttttgtagagacagggtttcacccaggctggtctcgatctcctgacctccgatgatccgcccacctcagccttccaaagtgttgggattacaggcgtgagccaacgcgtcctgccttgattctgtttttaactccattttttagaggaggaaattgaggcacagagaggttaaataacatgtctaaggtcacacagcaaggggtggagcggagttagcccactggcctagctctagagcccacccggataaccagaacttggtgaggcctccgggctcttgcttggtttggagccaggtgcttagcgccccgagcccggggccattcaccctgcaggagctgcacgcgcccctgacctcggcttttccctggcagcagaggggctttgcgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgct

SEQ ID NO: 165 - DNA, 1500 bp, Homo sapiens
caaatcacttgaactcaagttcaagaccagcctgggcaacatggtgaaaccacatctctacaaaagtaaagaaaattagccaggcatggtgctgtgtgcctgtagttccagctactcctggggaggtcgaggctgcagtgagccgcaatcacgccacttgtactccagcctgggcgacagagcaagtccccatctcaaaaaaaaaaaaaaaaaaaaaaaaaaaaggctgggtgtggtggtcccagatactcagaggctgaaaagggaggattgcttgagcccaggagttcaaggctgcagtgagctgcgatcacatcaatgcactccatccagcctgagcaatggagtgagaccctgactatatttaaaaaaaaaaaaaataggaagaaacaactcaaccacagggctagtatgttactcggttataaaatgataaagccctaaacagagaattagcccgtttccagaagaggccaagaacagatgatacagctgaactgaactcctgcctgtacagctcgttttctacaagattccagacctggaagatgatggcatccagcccccattgaagcacctcgaacaagaaaaacgccgagtccgaagagccaggccttgaacacacgattcctgtctataaataactccccctggggaataaaaagcaggatccaaggcaggaaacccgagccgtggaatctggtaagttcttaggaaacccactcacgggcctgagtcccccgtggaagcggcgacttcggcacctggacacccgagtccccagagccccgggcggccgcgcgtccctacctgcaggcctgataccggccgcggagcgctcctggccccgctcccgccaggctccgggaccgctgaaacgcacccaggggggtgaaggcgtagtcgccaaggacagcgcagatggcagcggaggcatgggagccggaacctaccgtggcaaagggccaggtcgggacgcccctcggcgcagccccaaatcctgcccgcgccccagccccgctcaggccgcgcccctgccacctctggccacacgggctgagacgtctggctcctgcacagcgcacttcccgctgcccttctccactggctgctcaggccctgcctcgccagcacggcatccgcgggggatccctacctgtcctttagggcttgcctcataggtcaaacgtcacctcccagggaggtatggcctgccccctggccaggtgggccccttccacgctcgcctgcaacaccacccacccaccttgataactgcttgtaaaggttgtactgctttcccccttgagactgcaaaccttcaagggcaggaaatgggtctgttttcctggcaaaataatgaagttggcttaaggttttgctgaataaaatgagtgacagacaaaagtagccaaatttggcactcctgatgggttatttgatgaaggaggtgcaatgtatgggcttaactagttattctggatttctttccccatgtta

SEQ ID NO: 166 - DNA, 200 bp, Homo sapiens
caaggccggtgcacgcggacccgaggattcggtagatgtccccgaagacccgctgccgctctaaggcggtggaagcgagattctccggaaacccagggaatccgatgctcgcacaggaccaaagcccgaggccgcggggaccacagagggacggagaagccgggactcctcacatcccacatccggcaggggaagcccag

SEQ ID NO: 167 - DNA, 2000 bp, Homo sapiens
ctgataataaagttttaccattttataatttaaaaatgtaaatatggagttgggcatggtggttgggaggctgagaccagaagatcgcttgagcccaggggtttgagaccagcctgggcaacatgcagaaaccctgtctctacaaataaaaaattagccaagcgtggtagcacgcacctgtaatcccagctactcgggaggctgaggcaggagaatcgcttgagcctgggaggtggaggctgcagtgagctgagactgtaccactgcactccagcctgggtgacagagtgaggctctgtctcaaaaaaacaaaacacaaaaaaacaaacaaaaaaaagcaaatatatgtaaaaataggaagtgcggtttcccaaaatgaggtctgtaaacaactgatctagaaaatgttctggaaaaagtaaaaaaggatcaggatctgaggtcaactgacctctccctgcgctctggacaggcaaacaggcaaggttccctctgaggccgtagcggcttctcgtgggcgagtccctgttcgcaggtgacgtgtggaccacgctcttccgaagcgtctggcctgtgtgctctcggggaggggacgcaggtcagcccacctagccgatggctaacaagtcagtttgttttctgaacggaagcttaaacctagaaaagtaactgggttggggtgggggtgtagccacatgcagtaaaagcactgcctgtctgtataacaacgacctgatgaaaaaaggaacgcgtgaaatggggagtgttagggcgtcacaaactccagtgtggttgaaatgaaagcagaaagcaaatggcaagctggcttccccttccagcttttcacaaccctgccttgctcatggtcagccccaagcacgggcggaagaaaggactggaggggagggaaaggggtggggagcgagggtaccagaggcgtgggaggacggggacaaaggggcagcaagggaccggcggaaaggaaagtcggcgttagctggattggaaacagtccagacagaacgatgggctctgctgcctccgggtggggcaccaagcggggagcggggccacgaggcaggggacagtgaagcaccatgcagcgcccaccagccggcagcgcccaccagcctgcgctgcgctgcacatggtacccgcggccccagctggccagtgtgtggcggagatgagaccctcgtgaagagactaagcggccacagcagggggaagggttgctcacataaccccatactgctcacactacgaggttaactgccgtgagatctgcctgcagccagcagaaacccgttctaggaaaacgttgcccagtgacttcagtgagtgccactgacccgggcgcctccgccccggcgtccggcagcagcaccgattgcgcaggaggcaccttgcaaacaacctttcctgatccgcgctgcagttcccaggccggttgcagccgtttcacagagactgcgcacacaaagcgtctccgtgccctgccattcacctttcgacacagccgcaacccctcttttcagtgttaaaacctggcgccaaaaggaacatgcgatgtgacgtgttacctctgcgcatgcgccgggcattcccagcgccccgaacctgatgaacgcgcggtggggaccccaggcttccgtgctttcgttttcctggaagctacgtgtcctcagtctacatattgttacctggaaaataaagttttctccttttttcttcctttgttaacaggcagaaggtgtaggctgcaggtttcgggcctaagagagggcatggctggcgacacggagtagactcctagatgacataacggaggcgagtctgcaccggggactcggcattaggaggaggcagaggaaaagcccaccaccgtggccgagggagatctagcaagcagcttgcagggggtgaagtgtgtgcaaagcaggctgagacctgtccagtatcgaaacacgccgcggtggtcaagcaggctttaccatgct

SEQ ID NO: 168 - DNA, 700 bp, Homo sapiens
tgaggctcaaaacaggtgtctgtgagcttcacaggcggtaaggccgtgtctacatggccgggacatgcatcccggggctgcccctgccgtgctgcccgagtgcacgggggatgaggacctgacaaggccattgatcttgcgggagcttcctgaactactccagcgtgaaaatcttccagaaggattctccacagggcaatgaggcaagaaatttacagcttagcctgattaatgggccaggcagttaagagttctttgccaagctatgagcataatttatagtcatcacggcaggaggaaaggccacataactcacatccttaaagggcccttagaacaagagacacgccggatcattgaaaacgtctccactcctggcgccaaaagagatcggcacgtttctgggtattctggtcaaagaacagggagtctggattaatatacacggcagaaaaaagcgaagaaaagacacacaggtcatatatttctgactgatattccgtttgttgttttcggagggacttggtatttatttaaccacattctcacttgacacgccccctccccacaccttgtaaatgccttcctctttagccgagtcatttttcatcacatagaattgaaatgttgccaggaaggcggtttatgagattgtagaaatggcactagagaaagcagtgtgaaaagaggcctagaacgt

SEQ ID NO: 169 - DNA, 600 bp, Homo sapiens
tctctacatgctatctactaaaaacttaggcaaggaaatgcatcagaccaaacaccccacagcacagagaaccgaccggccattgctttccaatctccgcaaacctaaccattgctggaagaaatcttactcacagtgcacagacagtaggtattttattgaagataaacatatagtggaacaaaccaaattacccccatttgagttacgtgagcactcagttctcagcgtggatgtcccacaaatcaagtcaacatttgcgtcccattaccagcagccacttgccgagtatctcttcgcttccactgggactgcctggcatccctgatgctaaggagccactgaagagcctccaaatgtctgacattcacaaacgcatcttttgctttgacccgacccttcaacctctccgagtctgctgccttttctcagacacacatccaggcaccgttagggatagttagagaatctgaaaattcagaagcgctccgaaaagcctttccaaaagtaatccacagcactcaacagtgaatttagaaaccccaatttttttctgagtttgaagtttttaagccttgcggatggttggagtaggaaaaa

SEQ ID NO: 170 - DNA, 1100 bp, Homo sapiens
tcagacaagctctgtgcagtcggaattttttaaagatgcactgtcacttgaggaagacaggtgatcttcctgcggcacaaatagaagcaaagagatttctcttcttctctgtagagcaacacaattgataaatggccgataatctccaccaaattggcagcagtaggctgcccgaaggcagcaggcatattcgtctttgtgaattgttttactatgatgctgtcacatttccaggaataagacggttaaaatgatatattgttgtggtttggcatttgcagctttgctctgacttccctggtaactgccaacatctgcaaattattatgtgcttaaaaaaaaaatcaaccgccaccgcaggctgcccccacggtccctggctgggccaggcctcctgccaggccacagggcagagttcttggaccaggaggcagcagggtcaaaacccaggttgcctaggaagcccccaaagacagttatggatagagctgggagcccgaaacacatgcggcagtctctcagtttccaggtaccggttctcacatcatccatgcatgtgtttgaggaaaaacaaaaaaaaattgatggttgccaaaaacaaaaatgcttccatatcaaagtttatcagtgtcaatgtcaagagacttctggttcgtagactcattttggcttgaggccaccagaagtgaactctggtttctaaatgcagaagcagaggcactggccgatcatggaagatgcagggaactgttcaagaggcccaagcctggtgctcagaaacttggcaggatcaagcatctcgcccaggaattcatcccctgcttgtctaagccggctggctctcgtgactgactcggaacaacagagcagatgtttgcgtgggaggcaagcctcacccaacatctgtcctgcggcgggaaggcctgggtgttcacagatagagctggagttccccggtgggtggcacagacaattagctggggctgcctcacatgtaatctaattacaggggaaacaggctcaaacaccgggtgataagcagcgcaactgtttcgggtgactctgtaatttttcctccattaattttctccataacgcac

SEQ ID NO: 171 - DNA, 250 bp, Homo sapiens
gttgcctgggatatgcttatatcaaaaacttacgtgtcacttacctagcatttgcatttcactgggcctcctaaattctgtgtggtaaccgactgccaccggacatgctgtttacttctctatcctcacgcagccagttgccacattcaacataacactgcaaatattgccggtggatcctgacttcctcgtggaccctactgtgtcgggaaaaacaaacaaacgaaccctggaaggaaacaccatgagt

SEQ ID NO: 172 - DNA, 600 bp, Homo sapiens
tcataaatatttccaaatgtattcctatttgtctctacagagtctaacagacataaatagcgaattgaaggttctgtcttaaaacccagcagaaagaaaaacaatgaccagaaaaaaaaaacaattgtctttggcttcccaagaacagcatcggatttcaactggaaccacagatggtccgttgatagaagcgactactttttagctctggaggacgacaaaaggaaccagcttcttcctgtgggtgtcacagcgaggtcgcctggccacatcaggtaccagagcgagcgccctcacctgataggccctgtacaacctcagccacagcactgtcaggaggaacacgcggaactagcaacctaggagggtaaaggcggagttgggagggaacacgaggcaggcaggtcggctggctgctgagctacaggctgcactcctaggacgtctacgtgtaattgagaaaaataagacaaaaataacttactgtgcaggcaattaattctggttggcatagcgatcctcttaagttaaagggaatgagcatgagatgaagagaagtaagaggcagaaagaattatgcaagagcaacatcagagtgga

SEQ ID NO: 173 - DNA, 2000 bp, Homo sapiens
acgccgagccgcctctgcaggggaaaccgaagcagatgtggtgagataatacatccaaccctgagtgctactctaacctgccagaggcggagggttctcagtgagatgaaagcattacagatgcgttagatctaagggaggggcctgcagatgcgcagctggcagagaaaccagggaggggctgaactgtcagtcgcgaccaccagggatctgaatcagttcaccgacagccttggggacattcaccttgggctccacaacctgtcagaaatgcccccaagcccaaaggcgtcgagagaatggccaggttgtttcagattgacacatatcctaatgtacaagtcagcccacacaccccacgtgcactgagcgtctcttgttgttcaccccaaataaactctgccggaactggggcgggactcgcaggggcggagaaggggggagacgggcagagggcagaagtggatggtgagaagagccaatggaggggccccgtgagagtgagcaaggctgcacccctaaccgacgtcctggggctactgtacaaacaaagaaccacaggctgggaggctgaacaacagacctgcactctctcgcagctcggaggctgcaggtctgaaatcgaggggctgacagcgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaagtaagttgacattcacaggtacctggggttaggattggacatatcttttgcaggggtgcagggggctgccactgagcccgctgcacagggtgacctgggccaagggcccttcactttcacttcctcattggcaagctgccctgtgtttggactgggtcgaggctgtcaaccttgctgcccctcggagtcccccctggtgtcccccaaacagattctaagctgctttcctggggctggaggccaggcattgggattttttaaagagcttcccagcaggtgagcagcctttcatgggtatcaggagaccttcctggcaaatgtggtgaaggtccttcctcctgagcgatgccttagacccaggagcccagggaggctgctcacctgatcgttaggacaggagcagtggaaacctctggcctcagaccccctggaggaatccctccctctaagactctgggactggtgcacgcaaggagctatcgtgaacattgctcccaactggccgcttgcttgtcccccggctccccttggccccagtggcggctttgcctgaattagagggcgtgagagccacctgtgtctcagcactgcaattaaagcaggaagccctttcggaagcagccgtgtgcaccagcctcccatgggtggagcagagcaaaccacccacttctgccctctgcccttcttcccttttctcgacaccctgcggccccccagtttcagcagagtttatttggggtgaaaaacaagagatgctcagcgcctgtgggatgtgtgggctgactcgtacattaggatgtgtgtcaatctgaaataacctggccgttatatggatgccttggggcttggggggtttctggcagtctgtcgagcccgaggtgaatgtccccaaggctgctggtgaatcagatccctggcgttctccgttggcagttcagcccaacagtttctctgccggccgtgcctctgcaggtccctcctctgatctgattggattaatatttgaatcaatagactgagtcaagcagaatgtgggtgggcctcatgcaatcagctgaagccctgaaaagagcaaaagggctgccccttcccccgaggaggagagaac

SEQ ID NO: 174 - DNA, 200 bp, Homo sapiens
gaatgttcaaagaaagagccctccttgccttcctcttcttccacccctgccctctgcagactggggttctgtagacccccaaagtaagtccgccacaccggaaggaagtgagttacacaggggcccacatgggaaccgctttttgtcctgtcttggtgggaaaatggccacgaccccagcccaggctctgccacgccaca

SEQ ID NO: 175 - DNA, 400 bp, Homo sapiens
aggcagcagggttaggacttcaacatacaacttttggggggagatgtacttcagcccataacacaccacgtgggaggataacaccgatttcagagcttgcagaggaagccgccaggaactccagtgagacatcagcccccaggtgcctgtcaggcacgccgggctgtggggggcacctgggcccatctgagtaacggaggcgcatccgcacttcccccaggagtacatttttagaacccacagcgccataaaccaaagacaaggagacttcctggtgccccgtcagcttctggaggcgacgttctcggctgacagctctggcagcctcccctgtaggtgagagacaggtaaatgggactcttgcttccaaaacggaacagggtaaaaattctcaagcgtt

SEQ ID NO: 176 - DNA, 300 bp, Homo sapiens
ttaaaggggagtggttgtatgaagagttcctcagtcaaaggtgtgcagctgggaagcccaccccacctaagagggaggtctgacaaactgtccacactgaaccactcagacctgcatcagggccccgtttcttccataagccgccaagtacagccctgagtcaactgaactcaggcctgggaggcttcccaaagctgacttgactcagctttgaactgaaatgaccgtaccatgacaaccctgatgaaaagctaaactgagcccaattattcaacagtaaaattcagttggtctcactca

SEQ ID NO: 177 - DNA, 450 bp, Homo sapiens
tgctaccagctgcttgggcttgggcaagtcaccctagctctcagatgtcatctgtaaatgatgacaatgccaatgtggcactgttctgagagtcagacagaacgtatgtgtgcttcacatatggtgctcatgaagtgctatcattatctaaggaaaacagaaaacgaagttcagagtctctctaaacgcatgacaccagaccaacagggagtttcaaaaaataggtctgaagtaaatcaattctcctggtctcaatacactgaaaacaaactattaggggactgaccgaacccaccttaggaaccaccttacgtcaccttctgtctctactgcaaaaccctcccttaatactgttcaaatacgctgacaatccagatccatatccaatggaaccagcaatcatgcctgtgtgccagcaatgtcagggagggaagccgatctctgatgaat

SEQ ID NO: 178 - DNA, 1300 bp, Homo sapiens
caagcctgtggtagggaccaggtcagagtaaacaggaagacagctttcggccaggcggtgcacctcggtgccggtgagtgtgagcgtgtgtgcgtgtgcacgtgtgcagatgtgtgtggacgctcccttctccgcagcagctcctgaccccctgcaggtgaccctcagccagccccagggctgcccccactctcccctgtggacacctacctcatttggggtgaagtggggggactggggtgtgaggggtgctttggggggcacacttcgacccctctctctgcaggccaagtcctgaggctcagtttcctcctctgtgccccggcgacgtggtgcaggcctcgcgagtgacgtgagggttcatgacccaggtgtgggcagccagcccttcacgggaggccacccacctggccacagtgcctgggaatttaggtcgggcactgccgatatgtcgccttccacaaggcgggcccgggcctctgctgaccgtgcaccggtcctggggctgggtaattctgcagcagcagcgcagcccatgccggggaatttgcgggcagaggagacagtgaggcccgcgttctgtgcgggaactcccgagctcacagagcccaagaccacacggctgcatctgcttggctgactgggccaggcccacgcgtagtaacccggacgtctctctctcacagtccccttgcgtctggccagggagctgccaggctgcaccccgcggtggggatcgggagaggggcagtgtcgcccatccccggaaggctgagcctggtgcagccagggagtgagggggcgggaagccggggtgctgccctgagggtgccccgacacgctctcctggggccctgagcggctgccacgtgcgtccagggttctggccacagggtgggcaggggccctgtgctcctcactggaggcccctgaggctctggaactgagaccatccacccgccggccccctctcgccggctccggcacccctgcctactgtgacttcctgccccggactcgctctgccagcttggggcaaaccacttccctctggggttttcacttccctctttcccaagtggggaaagaccacctgtccccgacccagaaagggcccctgcccgagggcagcagcagtgccaggctggcatgtgaggcttggggcaggcccggcccccagaggcacagggcgatgctctgtgggacgctgtgtcgtttctaagtacaaggtcaggagaggagccccctgaccccggaggggaggagaggcagggcaggaaaccgccaccatctcagccca

SEQ ID NO: 179 - DNA, 200 bp, Homo sapiens
gcccactgtgggtgtgcccgtgtgtgtggctgtgaggcgtgagtgcaggcgtgaagtgtctgggagtgggagcgggcatgagtgtgtgccacgggcctgctgttgggtccttggaggccacggttgcccctgaagggactgcaagctcttttttgatttgtagttatttgagaagtctatacaggaagaaaattaaaccg

SEQ ID NO: 180 - DNA, 1000 bp, Homo sapiens
agcgcccagcgcagggccgggacccagagtggactctaccgtggggctgcctcaaagaaatctcagcaaacacaggaagccagcccacccgtgcagccatggggccaggaagcccgccctttaccaagtcatttgggcattttttctctgtgctaacagcccagatggagccatagcctcaacctctgtgttctgataacaccaagctgggacgccggagccatgcaggggacagtgcccggcctgaggctgcagcctgggtctggatgcctttctaattcagggcctcctcatggcctggttccataaatggtcaaatgcagcctgacagcgcagcctcctatcagcgctgggctccgtaccgccacacagcccacataccccgttccccaggagacgcccgcaggtgggcagcgtcactcccacccgccgagcacacgctgtccccgtctcgtgtcccgaggagccggaagcagctgcttcctcccagcctgaaagctgcacctcgggctgcactcggctccccgaacccgccctccgctgccctgcaattcgccaagggagctacccttcccatataaaaatttcacctccatttccttgtagagaagaaacatttctgacagcaaggaagattctaatttgaaaagcaagtgattcatctcccggtgccaaacagcagacgcaggcgttaccagtctgggtggggcgcccgagctggggacctggggtcctctgggaggggcaagaaggcagcgatgctggcccccgcctccatctgcccatcccatctgcttccacacaccgccctgccgtagctgcttgcagcccttctctgtcagtttctccatcttttggtttggtgataaatgagagttcccatcgggtgtgccaccctctgtgtgacggggagcagagaagaccctgcgtccaagtcctcctgggggaagagcgaagatgctgggaccagccccagctgtcagggggtctccaatcccag

SEQ ID NO: 181 - DNA, 300 bp, Homo sapiens
cgcacacacagcacagacgcctgcatcttcccatgcgtggtttctgctcttgcctctctgggtttttgtttcacttcggtcgagtttttggtggtgttgagcggatagccggggaagttggagtcttgtttgtggccgcctcgtgctcgtgtctgtatctaagatcctcaggctgctcctttttgggtaaggtctgttgcttctctaggaacagtgacggtggcagagcccgtggcccctctctcctgtcccagagccaagctgtttcctctccccactcccgggcaccctgcgggcaag

SEQ ID NO: 182 - DNA, 5000 bp, Homo sapiens
aagaggaaattcccacctaataaattttggtcagaccggttgatctcaaaaccctgtctcctgataagatgttatcaatgacaatggtgcccgaaacttcattagcaattttaatttcgccttggagctgtggtcctgtgatctcgccctgcctccactggccttgtgatattctattaccctgttaagtacttgctgtctgtcacccacacctattcgcacactccttccccttttgaaactccctaataaaaacttgctggtttttgcggcttgtggggcatcacagatcctaccaacgtgtgatgtctcccccggacgcccagctttaaaatttctctcttttgtactctgtccctttatttctcaagccagtcgatgcttaggaaaatagaaaagaacctacgtgattatcggggcaggtcccccgataacccccagctgcagatcgaggcctagtgcgagcacaggtccccccagacccttcccagtgcccaccaaccggcggcctaggccaggtagaactggcagcgcctcccctgctgcaacaccaggctctggtagaaacttcagaaaacatgcaccggcaaaaccaaggaagggtggctgcgtcccgggttcttccgcgcagctgtgtgtacacgcatgcacacacccacacgcacacacccacgtgcacacccccatgcacacgcacccacttgcacgcccatgcacgcacacacgcgcgtgcacccatgcgcacgcacccatgcacacacacgcgcgcacacacccacgtgcgcacccacatgtacacacccacgtgcacacacccacgcgtacacacccacgcgcacacaccgctgtccccagccgtgcagaacgatcctccctgagtccccggctccgacccacacgcagcactcgctaaacgcttcccacgcagtcgttttgctgggttgcgcttcacccacttctcagagggggcggccgaggcagaggtgtcggggatcgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccctgacagtgcccaagctgcccatgggattggattcgccagagcctcctacgcagaccccacccagggccaaagccaaccccaagccccaccaccttggtggtgtgggatgaaaagtgagccatcgagagatggggtccccccacccccaacccctccaaggacaaaggcgggctgggaagcacccgctttcacgtccgcccctgcccggctttcctagcggaattggcgccggcatcagttgggggttgtgggatcagtgaggaatcccgtggggtcgcctccatttatcagttgtgtggggttgggcgagcacccctagccccagcccaggcgatcagggcgcgaagcccactggacgcggatttgggattaggacgggggtgacagccaggaggaccgcacctgccctccccactcctgccgctccacccctgcccccaccgcaacaccaaggtctccaccaggaagatgggggtggggaaaggacgcggggtgggggggggtgcggggagagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccctggccttatagtttagaattttataaaaggaaaggcgtggccactgacaatttgcgcttcaggagtcccagagtgaccgcctggctcggagcagggaatgagggggtccttaactctgagatttgttttctgagagacaaaggtgatgggtgaggcggctaagcctctgattctctataggtggcggtcattcatttcagaacatgaatggattcagtaaataaacatgatagaaaaatgccacaagccctaggcccattggagtggactggacagtctgttcccagtgtgtccctcagcctcggtcccccacccttcccggagccctgggggtcacacacatccctcctggctgcctagcctgtgccccccgattccccccctccccgccccgcgcgtgcacacacacacacacacacacacacacacacacacacaccacacagcacgaggcgacagagatatgagagagagcgagcgagagaggacgggagagagagggagtgcaagtgtgcgctgggggtaacccgtgcatgcatgcattgggggtaacaggctggagctcagatccctcccccagcccccagcaggggggactgcaggctcctggtctgagtggggagctgggccccctggacagaggactgggctgcggggtcaggaatgggcacacttcctaactgcaggacactctaagggctttggtcatgcacacgcagccaagagaaggtgtcgctggcacacagccttccaggagcggacttggagacctcgccaaggaccaggactccccagcactcacactcccttaggcgctgaagtccagaggacagaggttgagggcagagctcctgggagcaccagtggaagtaggagggctgggctggaaaacctcccccaacctcctattgcaaagaggctccagccagcagcctccacaccccagtgatcttttaagatgcaaatctgcgccatcatttatttcctcagtgccttctccagctcctgggatgcacactgcccgtccccaggcccagagacctgaccaccctcattcctccctcagcccaccctggggtctctccaccagctgacagccttcctgcagtcccctccccgaatgctgctccctgaggccctcctggacacctgcagggcaggcacagcccgcgggacctcacagcacttgctccgggcagagctgcagtttggccaagttgccagctccgtgtgggcaggggccctggcctgtggctgccacatcccgggtgggggcacggcctttcctggcgtggatgctgagcaaacgtagggggaaggggagtgaatgaggagagccaggtagctcaggggctgaggcctcactgagcagggtcccgcgtgaccggtccccaccgctgacggttcctggggtaacactcaggacagggagaggcaatggaaagagacgtggccgccctcgcatcctgcagctcccgcactcccagcctcccagcctcccacccagccccccagagcccaccagtgaccccgcccactgggtcctcagatggctcccacgggatctcctgccttgatctcctgtccacatggaggtgaagtgggttgctctgaatgaggggtgccgagcctagggcgcagcccactctcctgggtccgcagcatcacgcagcccggaccacaggctccttacaagaatcggaagggtccctgcaatcgcccttcgcactgaggcttcctactgtgtggtgtaaaaacacaggcttgtcctcccttgctgcccacggggctggagccgcctgaaaatcccagcccacaacttccccaaagcctggcagtcacttgaatagccaaatgagtcctagaaagcgagagacgagaggggaatgagcgccgaaaatcaaagcaggttcccctcctgacaactccagagaaggcgcatgggccccgtggcagacccgaacccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagccagcggggcccacgctaaggcggaatcccacagaagcctacagagcgagcgcgcgcctgtgcttcccaaaacggaatggaaccaaggtgacttctacagaacgatctgaagccctggctggcccttatgctagtctcttgggagcgttccaaatgcagctcaatattacttacttgacttttatctttcctccctggttcgtggtatttataactgggtcatcttttaactatttgcaacgtagcttcaggggagagggggagggctttataaataacctgtattattattatgcaggttgattctgttccctgagctaaagggaacatgaaaatacatgtctgtgactcatgcccccccacccccactccagggtgtgctgaggagtctctcagctgccccggggtcctcgagcaggggagggagaaaggctggcgctgcgccctccatcgcgtgaagccaggggattttgctctgcgacaagctgacttggctctcgtattgtttgcagaatcacccagttccaaggcagtccctgcgggcaggtgcagctgtgcgggagcttcagtcctgtccccaacacccaggcagtaatggttccagcacggaaggtctacctacctcccactgcacagcccgagggctgtcctggaggcacagccatccgtccctgggtgggcaggcacgtttatgacccccacccccacccccaccccccacgcgagtcagcacgttccatactcgggtgatcgtgctcatcccctggtcatgtcatcgggatctgagtgccatccgagcagagagctgtggcccggtgccgggggtggacttcatctattccagggaaccaaggatgcatgatttgcaaacaaaaccagaagcgcaagccatctcctcgcctcccctgatagccgtgctgcggagcctgagtgctggag

SEQ ID NO: 183 - DNA, 400 bp, Homo sapiens
tgcgtttagtgtaaaaatatcaggtgtggctgcacggagtgaaaaatcacaggctccacggagccgggaggcctgctgccctgccctcttgctttgatgaggaaatggcgaccgcagaaggaaatgtagcagcaccggcaaccggcatccgtggggccacgccgggctgcttcccagggccctccagccaagcagccacaggaaagagtagatgttgatcccaagctaggactgaggagtccgtccctaagagccgagggagtcaggtgggcgaaactggccgcatgtctgggtacaactgctcagggtttctcatctgctgaatcaccaagctaggttctgaagccaggcgtgagtgagcaggactggagcaggattctgggaacaatcttttccctcc

SEQ ID NO: 184 - DNA, 293 bp, Homo sapiens
aggtggaggttgcagtgagccctcctcccctcctcccccttcccttcccacctcccatgcccccctttcttcctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccag

SEQ ID NO: 185 - DNA, 474 bp, Homo sapiens
ccttccagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttcacgttgcatcgggtatttttcgttattgtaaataaaacggttccgagccgtggcatcgagagggcgtctggagttcagggaacgcgtggcccccgcccgggagcaccgcgcagcgctcgcctctcgcccttcaagggggtccctgcccggagcctgcgcccccggagaggaaggggctcgaggggcttgggtgccgcagcgcgtccttccgtagaaaaggcttgcgtcagtatttcctgcttttacctcctgag

SEQ ID NO: 186 - DNA, 346 bp, Homo sapiens
cagtatttcctgcttttacctcctgagtattggaatattcgagtaaaccctggagtttcagcgccagcgcacgcctcttcatcagggcagcgcgtcgcgagcgcgctggttccccggggcctcccggccacggacaccgctctagccagggccacggcgaggccgccgagcagcacctcagagacctgcgtgagttctaaagcctggggctactacaattctgctcatctgtttgtcctgtgaaatgattcagggacatgaaaatgccttcccactgacttgcgtcctgtcttagcctggacttgtccccttgggaacacgggccaggcccctctgttcctgaagt

SEQ ID NO: 187 - DNA, 2000 bp, Homo sapiens
catacatggttattagaaaaggcatctcatccaaatgtggtggctcgtgcttgtaatcccagtgcttcaggaggccaagggaggaggattacttgagcctaagagtttgagaccagcctgggcaacacaacaagaccttgcctctacaaaaaacttaaaaactagctgggtatgatggtgcacacctgtagtcccagctacttgggaggcggaggcgggcagatcgcctgaggtcaggagttcgagaccagcctggccaacatgatgaaaccccgtctctactaaaaatacaaaaattagccgagtgtggtggtgcatgcctgtaatcccagctactcaggaggctgaggcaggagaatcacttgaacccgggaggcggaggttgccatgagccgagatcacgtcactgcactccagcctgggtgacagagcacaaaagacaggcatgactttgtacttaactgctcagctttgtaatcactgggggcccagatgctcacttggattctaactttgttggcatctgggcctaaaagccgtgatgcaggtgagcaatgatgcagagggctctgtgcgcctggcgggctctgtttgcctgctgggctctgtgcgcctgctgggctctgtgcgcccgggaaggtgcggccaccctcacgcggaaggcggccagcggatcccggtgcgcgcagctcccagcgctggggttccagcgccccgcctcttcctatagcaaccagcgggacctgccgtcccccggggcaccccgaggggtctgcgcccgcttctttccgaaacgggaaggcgctgggggctcggcagccagagggacgggttcagggagcgtccggtgagcctaagacgcgcctttgccggggttgccgggtgtctgcctctcacttaggtattaggaaccgtggcacaaatctgtaggttttcctctgggggtgggcggaggctccaaaccggacggttttctcctggaggactgtgttcagacagatactggtttccttatccgcaggtgtgcgcggcgctcgcaagtggtcagcataacgccgggcgaattcggaaagcccgtgcgtccgtggacgacccacttggaaggagttgggagaagtccttgttcccacgcgcggacgcttccctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgcggcggggacgctgggccgacaggggaccgcgggggcagggcggagaggacccgccctcgagtcggcccagccctaacactcaggaccgcctccagccggaggtctgcgcccttctgaggaccctgcctgggggagcttattgcggttcttttgcaaatacccgctgcgcttggacggaggaagcgcccacgcgtcgaccccggaaacgaaggcctccctgatgggaacgcatgcgtccaggagcctttatttactcttaattctgcccgatgcttgtacgtgtgtgaaatgcttcagatgcttttgggagcgaggtgttacataaatcatggaaatgcctcctggtctcaccacacccagggtgacagctgagatgcggcttctccagggtggagcctcctcgttttccagagctgcttgttgaagtcttcccagggcccctgacttgcactggaaactgctcaccttggcatcgggatgtggagcaagaaatgcttttgttttcattcatcctagtgttcataaaatggaaaacaaataaggacatacaaaaacattaataaaataaattaatggaactagatttttcagaaagcacaacaaacacaaaatccaagtattgccatgtcagcaacacattcctactttaagttttatgaagttaattggagtagtggagaacaaaagtggatgtggggcag

SEQ ID NO: 188 - DNA, 149 bp, Homo sapiens
gctggaccagaaagtgttgagtacctgctcatgcgtgcaagaggaggagggaggagcacatcactgaacttcacatgaaattggatacccgggattagagacagtagagggttttggtgaaatcagatacacattgcaaagcagcacac

SEQ ID NO: 189 - DNA, 146 bp, Homo sapiens
ggtcgagtttttggtggtgttgagcggatagccggggaagttggagtcttgtttgtggccgcctcgtgctcgtgtctgtatctaagatcctcaggctgctcctttttgggtaaggtctgttgcttctctaggaacagtgacggtgg

SEQ ID NO: 190 - DNA, 133 bp, Homo sapiens
cctcgtgctcgtgtctgtatctaagatcctcaggctgctcctttttgggtaaggtctgttgcttctctaggaacagtgacggtggcagagcccgtggcccctctctcctgtcccagagccaagctgtttcctc

SEQ ID NO: 191 - DNA, 95 bp, Homo sapiens
ctgttgcatgagagcagaggggagatagagagagcttaattataggtacccgcgtgcagctaaaaggagggccagagatagtagcgagggggacg

SEQ ID NO: 192 - DNA, 127 bp, Homo sapiens
tgcaggatatttggcaaggtttcttactgttccaagttttttttccgaaaacctcccttgaaacttttgtgcttacttgtggtaacatacccataatataccctcttaaccatttctaccggcacag

SEQ ID NO: 193 - DNA, 104 bp, Homo sapiens
tgaatcagttcaccgacagccttggggacattcaccttgggctccacaacctgtcagaaatgcccccaagcccaaaggcgtcgagagaatggccaggttgtttc

SEQ ID NO: 194 - DNA, 127 bp, Homo sapiens
ccgttatatggatgccttggggcttggggggtttctggcagtctgtcgagcccgaggtgaatgtccccaaggctgctggtgaatcagatccctggcgttctccgttggcagttcagcccaacagttt

SEQ ID NO: 195 - DNA, 144 bp, Homo sapiens
ccaggcaagatggcttatgtctttaatctcagctgtttgggaagccaagtggaaagattgcttgaggccaggagttcaagaccaacctggataatgtaagaagacctcgtctctataaaaaattaaaaattggctgagcatggt

SEQ ID NO: 196 - DNA, 110 bp, Homo sapiens
gacccagacgatacctggaaattatttgctcatgtggcagtcactgttgattgcctacccaaagccattactccttctccccacctaacagaagccgagttttgttcagc

SEQ ID NO: 197 - DNA, 101 bp, Homo sapiens
ccacatcctggccatctacttcctcttaaacaagaaactggagcgctatttgtcaggggtaagtgcgaccctagaggcgatcgtctctgctgtctgtggaa

SEQ ID NO: 198 - DNA, 88 bp, Homo sapiens
tgagctcacaggtctggaaatggtctgaatagaaaggattggtctccggaggaaagcatactcttcctattaccagaaccctgtgggg

SEQ ID NO: 199 - DNA, 128 bp, Homo sapiens
attctccacagggcaatgaggcaagaaatttacagcttagcctgattaatgggccaggcagttaagagttctttgccaagctatgagcataatttatagtcatcacggcaggaggaaaggccacataa

SEQ ID NO: 200 - DNA, 836115 bp, Homo sapiens
  NC_000021.9_gene_539 [gene=DSCAM], region 40010999..40847113
tgactgaggccggagcacggcaaagatgagcctgcccgcccgcctgctgcctggatgcggagggtgagggctggcgcacgggaggccgctggctgcgcattctgggcgccgagtgcccgggatgagctcacgcccgcgtctgcggctctctccacctgccgacctgccgggggcccactgagctgacggcgcacctgggctccggccgcagcgtggggcgcggcgcccgggagcaggtgtgcaggagcgcagcgcgcggcgagcgcagccctcgctccggagcccggccgcgccgcgtgcccgggcggctaggcagcggcggcggcggcggcgggcggcgggcgggcggcggcccccgggcaggtgccgagcggcgagcggagccgggccgggcggagcgcggggggcgaggccggcgcgtcgctcgcgggaggccggggagcggcaggggcatgtggatactggctctctccttgttccagagcttcgcgaatggtgagcctttcggtttgtgatgaatttcgtttccttatcattgaccgggggggcgggggggtggggggtggcattggatgcatgggtaaagtcttctttctttttccgcttcatctgtgtttaaaatttcgtgcttttatttattttttaaatatcatatttattttttgggggagaagaggtggcaatggagaggcccgggagaaattgctctgtaatcattggaaggcgcttacctagccaagtgacagctcagagcctaactccagtactagagagctgcctcattcagaataaaccaggtttggtgacagaaggagagacaggaagattgccactttgaatattacaacctggaaagggatgtgacattccaagtgcacgcaagtggaggggtcaatgaggaacatctcccttcagattcaatgctttttgagatttttcaaacacgtaatttcatgctagtacaatgtatctccagcaccaaggagggctttaagaatgttctgtccttctatgcaccccgtgctgcttcatgctcctcacagtcgtttatgtaaaaatatgcactgataagcattacatcatctgaaatgttgacaaattaaaaaaaaaaaaacacctgtatagttgtaaaaatgaaatcagtgaatattgtaaatagcatacatttcctcatgcccagccaatattatattttgaaatgatttcttcctgggtatttagaaagctattgctcttgactgagtcagacccaattagtaagtgtgactgcaccttaggctgcctgtcaccgcataaatatgaacttacatgtatgaatggcttcctctcttgtgggaaccagaggaaattgtcatcatttgacatcgcctgggagtagctacggcttaaattcccatttcaaattttggaacacacatctgcataaaatgtataacctactgacagttgaaattaaaccattaagcagaatcccctagccagaagagaggagagagagagagagaaagagaggagggagagagagcgagacagacacagagacagagagagagagagagagagagagagagaggagaagaagagaaggtaaaagaagagaagagaggaaatctggcccttgtgagaaaatacgagaagcaaaggggaggctctaagattttcctggaagacacacagggaagctctgtgtgttggctgcaaggcagtgcattttctttgcctacctagacagtgcctaaagaatcagcataccaacaggccagaagaaatgcatgagcattgtcaattttttaaaaaaacggtgactaagaaaaggtagagttgaaagaaggtactatcaaaatgaacatgaaaatgatactttgctctccagtataacctaaagcaaagtgtttgaaactttcattttgagatttcctagcaggaaagaattgcaacaagttctgacaagacacccatctttcccagagggcaccatacctgtcctgtgtcctcctgggaatttcccttcagggacagatgtgcttagggaacatgcggagatgtgtcggggaagtcagccctttctgctcttctgctaatgcgacctcctaagaaatgtagagatgcctacacatgtgttccaaagacacagagccttgacaccctgtttcgcctgtcagggagtacctttctgaactccttggaaaggcctgggttataagaagaaacaaaatttgcaccccattgggaagtgtgtgtttcaggatgatgaaagaggctgtgctggttgtcagtcagccagtatttatttacagttttagcattttgtatgacaaaatggtatggaagaatttatgatactgatacagactattagcctctgatacagagatgctatatgtgtgtgtgactttttttctgaatcagcattttataactaaaataaacaatcatagaaataattatatatggtaatacaattatatgaaacctcaaatattctgcaatatgaaaaatatatgcaaaaattatgtaggtactcatatagtgagttctgcaagtattattttcaagacttttaaaatcaactgataatcaccattattgtaataaatataggtagattccacaatattagacataaacagcaaacacaaatgaatattttacattgctgtattacgtattctgatccaatctagcagaaggctatggaactgtcttgtataaaaatgcccctctctttatatgatcaaggatgaaaacattaaaagcctgctgtaaagctttaggatctttgaaggggggaggggaaatcagctttaaacagttttctaaggtatggtgttcattacatactggggaaaggatcataaaatatatagacatgttgaaataaaataagaatccagtttggaactatgcctgtttgtaagaccatatttcaaaaatataagagtaaatggtttctacctatctgaattaaactttaaaaaattgagaatatttttgtcaacaactgtcatattttgttatacctcaactttgaaaaatttctgaatgtgtgtgataaaagattgatgaattctaatacctaaactgattattgctaggcctcaagcatcaaaatgcctgacatgataacttttttttttcatttgtaaaagattatgtagtttaatatttggggctattaaaataagcccacaatacatctgcattttaacagtagacaacaatatttttcttattgatgtatcagaagtacagttatttcttaataaaagtatggttgctagacaggctgcaggcagtatttttgaaaaaaaaaaaaaaaaaaagaagaagtcagtgaccaggcccttcataggttaaacccttaaatgaatgacctcacctgatgaggtgcagtatcgtgttttaaagcagtcaatttgttctgcaatgttctggaaatacacgcgagcttctgttacagtgcaaggagccaaggtacacgtatgtgcagacactcacccacacacgtccctcggtgtcttctcagcaaagcttcctactgcattgtgtttcattaccatttctcctggttttaaccccagagcacattctagtttaaaattattgctaaaagaagagccaggccttcagacaaacagaatgatgaagaattagatttattatatgtaatatagttttgctagtatcctggcatctctgtttttacacacacacacacacacacacacacacacacacacacacatgcatgcattcctgacatcatcttttcctgagctgtgggattttcagttctactgcatccgctttcatggggcctgagggtcatggagattagagacggtggggtgctgggagtaagaaggtgctcattaaagagaagatgagtatgcagcacctttgagcttcatccattcacttgataggaaattacagagcacacgcttgctattttatttaattagaagcagacctttgtaaatacaaatgcaccttaaggacttcaaaggtgatttttatttaattcacataaatgtatgtaaggaagaaatgttatcaggtgaacaatttcagggctgcctccacttccctttctcccccatctttattaaacagattaaaaagctatccataatctcagggttcacctaaattccgaggccttttaacttaagctgcatgcccctccaagatgccctctgtaggaaaacaaaatgccacgcagaccttcaataaatgccagtggatcgttctccactttttgactctctcctttgtcattttggtgtgaccacggtttgctgcctcgggggatcagtgagtcacggggggcagaaccagcgcaatacagcattctggtaggggaactaattttgactaaaatatttgccaattctaatccccaattcctggacctccgggtagctggcaaggtattttatgttagatgtgtctggagtaaggtgcacggagtatttcgacaagagactcaattcaatgcgtattaaaacttgattgagagagggagagagagaggtcattttataaagaaagacctgtgaacactgtagattggaaatttatgtttgcaaaataaaaggatgggtttatcaagtggatgcatttacaaaatgtggcatccaggtttcgtaaaattagctgaattctacgggtaagattatgaatgtggctcataaataattaataggtagtgaaaaagaatgtattttgcattaggcagtgcattcaatagtatttcggaaatgagcacttcgatttcctcggtttccatgcgtggcccacctctccagagcagggcaggcacccaggggtgtgcccacacaaacaagcgcgtgtgggcattttcttggctgctgcgctgaagtgcacgctgggccttggtgcccgcaccctcagcctgggagatagggaggtggtgctacctgcaggccgattgtgtccccgccataggacactagtgggcggcaaacctcacaagactcttgcagccagccttcagcagagccagcaaacccagccgccaccgagggaggactgctccatgcagatggtcaggggctttcttctgaagacgcctcccccacgatctctcaagttcactgcgcccaaactccggcgtcgtagagttcgtctaacaggaaccgggcaaaggcaaccgcaggtcaggcgaggtccagcagcctttgttttcaactgtacagcggaggaccgtattcacagcaatatctagaaacctagaaggtgcccagaaaggaaacacaggtgttgcagcgggtagcgggcccgcagaagggtgcatttgcaccccctttccaaagccgcgagggaaccccggcgtggcgcgcgcctcggaggtggcagctccgggagcagctccgcgcctgattggctgaccttccaatgtcattccaggagccgccgcttctcctgctgatggtgacaggggtgatgctgacgtgcccgctcctccgcagtccatcaatctccgcaggcaaggctccgggaccgggagcccccttccctctcccccaggcccactggaaaacacctgttcccctggactggggggttaactcttcaagttccaaagacctgggcacaaaaatgctcatcttatctctccgcgcccctccccccaactatatttatgttcttttcttcaatgttgtgaaaatgccagaaaattcaaagttgcatttcccttgccgaatctatgggttaagataaggcagtgggaatggaagattccagcagccccacggagtatccactatgtcgttctgaattcaaagggtggagcacacggatgttttctgcaggtgacgcaaggtctgtcaaggtggcaggagggaagcagggacaggattttggttcagaggtcagacagcttctgaccaggacgttcagaagggttgggtttcacaaatctgctcctgaaaatcagttccctccatattatcctttttctaaaaatcttggctgtttccttgatggagtctgtggtaatcgttacgcctgcatttaggtgatgctgatttggctagtgactgcctctctcactagctagacaggagcctccatagtctgaaatgcgtgcgaagcctgagcgtgtccttagcacagagcagagcacatggtatggagtagtggaaatagatgatgttccttacggagtgaaaggaaaaagtgataggcagagcctttctcccctccttaactcctgtccaccttcctccctcccgtccacctctctcttctgcctctagctgattggctccccctcttagtttgctttcctggacttgctctcctggtccctatcttgcattctgactaaaccactggactcttttgctctacccacctttttctgtcgtagtgactcaatcacggtagaaatgtttattttccagaaacgcctgtggcttggggcattttcttctcttttcaaaaagagattcatatttcgagtatctgatgggacttcatcactgttgcacaacagctatgtaattgctttaggtgctcttcctgccgtgcagtgggtcaagtgtcacagacaataatttcatccatgtgctggaccccttgttctcaagtgtacgctgctaaatggcatgatttaaaattcctatacagtgtttattgccctgtcgcattttgaaagccagccagaaacatcaaaccgacatttaggttccccgcccactccgccacccccagctcttgggaattcatttcttcatcaaagagccacccaggacatcaaaacaaagcttactttctcaggccttaattcatctttaaaaagtcatactactgttttcttcagcatcctatggatttatgggttttttgtcattatctttatttcttattttgcagattcaaatatgacagttgctatcttcatcaaagtaacatgaaaggatatcttaatcattgttaaagttgatttttgtccaaatataaaaatcaaattaagtgtcttatagcttacaatatttatcagcttttgatttttggacatctctatttgttctatgtgatcaacgctgattttttaaaaatcatgcaactggattaatttttgatcttgaagccccctggattatgtaaatacatattatggtttaacagagagggatgaatgggattgagaagatatatgtcaagatatgaagaaggaaagaggctactacacagagagttagaatgacagggattaatgaatcttgcctgtatccctagttattttttttactgagaagacagtgagtaagatttaagagtgagcaagcagtcctatttatagaaagctgtttttaagtgcagccgcaaagacagtgaaagaaagaattgaaaatgcaagagatcacctccatactaaatgctagcttcccctaacgtcccagctctgtacagcattttgtaggagaaaaaaacaaaaaaaaaagcataccaacccttgcagaaatattatgaaatctctttggactctctgcagaatattctagaagtgctctcagtctttaagtctatgttaggcttgggaagctggggatgagaaggcaatatatatattatctggaaacagcttgagtaggtctgaacaaaagactggaggtgaagggaggacattgaacttgcagcactgctacaaatatttattctgcaataagccttgcctttcttaaagatgtttcacggcagaatagtaggagggtgaaatctgcatacatctcagtaataaagcaattactgagagaagagttcaaatttaggatcctgtgattatcacaagtccctccatgttaacctgttctcaaactctggggttttaaattgcaatatatgaagtccttatttgtcagtctgtgtcgggcagacaatatcaccccaggctttgtgattgacacaaatgttattggacaagggaaaaagaatgccacatgctcttataaatgaaatagtctttataagattccatatataagtgagatcatggattttgtatgtgtgtgtctggcatatatcacttagctaatgtcccccaggttccttaagtatatacaatttagcataaaaaaagaaatgaaatagttttcctttctaggcctgtatttgttacttatagcattctggttttcctggttccaagtgggctttgggttttattaatagtagaatcgttgaatttttatgcaaatactgctgatttacaggttggaaatctggacaaaatcagacctgccctagaagatgatgctgtggaaagtgtttgccttttgtcttataaagaaccatctataaaatggatcattttgtcgctagtctctccagactatgaaattggcattttgataaggtgatggaaagaaatttgaactatttaattactgattttgattcatacaagccttgactcttttagtattaaaatgaagaaacaggaaacagttttaagtctggttttacataaaatttacacttttttcacactgaaaataaaacagtaaaagccagcttatagttctttctaaatatcccaactttctcattattggatgcttctgcaaaacagcagtatggtgataccactcccagtgttgaccttgatgacctgagggtcccaaagtggcttcagcattatcatggagtcaccacaatgatcaggtagaagctggtgttaggaccagcgtgaatgggtcacaggggctgaggggggctgttgggaggtagcccatgccgtatactgaagagccatccatgccacttcaggtgggtgattgcagtggactctcttaccattgattaatcttcctaatattgagtaaagcattgattcttctcataagcatgaactgctggatgatgggaacatttctgtgattgtatcataagagaaagacaagtagaaagataattagaactgctgcaattctatgtatattttaatttaatttatttttttaaatacaaaagacagctatatttcctatataataaggaaacttattactttaaggaaatatactttctcacgagagaaactcaagattcaattcttttcacagttagccccgctgtggtgtgatttgatcttgggttccatagagatacagaaaatccaagtcccagtctgcttaattgccatgtttattttttaatctcggctgtagagcatttttaataactgatatgtagcttgcagggtagaaataacaatgctttggaatattacctgtgagactttaggaatgagctgaagacacccaacaatgacaacaatggcctctaccagcaaaacgggaaccatgactactttatcactcctgccggatctagttcttgtcagttcctgcaaaggctagtcacttgtctatttcgttggctagtgaaaaggaaatgcacaagaaatgtggaatgctgtctaacagacagaatcctcctttcacaagttgtttaagttggcagcccaagttagcaacctctatccgggtccttaacgtgacagcagaatgtgggtaggatggttaattaccagatgtgtctgttatgactcacccaaatcaatagctattaaatccttggtggctactgttttagaataggcttcattgaatatttgtatagaaatctgggtagaaaaatgtggacctcgaggtgatctaggtatttgttttgggcaaggaactctcatcagtggttggtttatttgtgtcttgggggatctcacatcatcagcctttattaatcacaggcacgaggggccccacactctcccccatacctctaccgccccattgctgaggatgggagagtaagaatatagaatatgctgtaggcttctgtgggattagatgcttggaggcagcggaggcaaatgttcatgggaacactgaatatggaggaagaggctgtgccagccccatagccacacatcccctccacccttacatcaggataagaggtagaccacagtctgttgacacttcaagctgaacattagttagtatccttctatgtgggccttcccaggtaaggatcgaggacactggttctcaacaccccggtgttctgggtcagggagaacagagaaaggagatatggaagtttcctgaaatgcatttcctctcattagcctcctgttggaaattctgatgccagcgttgtggggaatgggctgtagtttggaaagctccccaggtgtttctaatcccatgtgactttgtcttgtttttcccaccaccactggggtctcccaagttatggtttccatgtttgttatgtcgtcttccagctctgataccagagagtctgattctgtagccttggtgtatgcacgacctgtgaatttgcattattaacgcatgcctttgcctgttctgatccacatgaaccataattcacctttgcaaaacacacacttgcaaagaagctacccaaacagtagctaggaagttgatccagtaaagttccaagtacatctcgatgaactgttggagaactctgtattgggtagtaatttattgggaatgtctgtatacagggttaggtcttcactgaccaccataagaatttgggcatctttcgggataattggtgctggggtttagtaacaagaaagattctgagtagaggggtatgtagatcctgccagaggcactcccaatgtggatgctagcagcttacgaatcatctgtgtgtattaatatctatctctttgcaccattttttcttcctgttagcgtatttgatattcaggtttataaatgcttgtgctttgcttatggtcttgattccattgtatttctcacattggtcccttcttcgatagcagctggagtcccagcagagaagccctttgaaacctgcctgtaaccatgaagctccaggcaagagatccatagtgggaaaccatttgggtaactctactgaacaagcttaagagatgagctagaacgggctgagacagggcaggagagtggatctgtttgcagctagaggttttgctttgatgccgccttgggatgctgcacattcctttgtccagggcacaagctcattccagagccagatctgaagggctttgggtcatttgctctgttggatgttcttggctttcttttaggtaaataatcacaagttgactgtatttaccatacaaagtatatgtcattatcctaagttgtcagaaaaaagagagaagctggcatataagggcatatgtgcattttaaaccttgttacatatatgacaaaatagagggcagttattggtggcagattaattttttcaaaacatcgtgtccttgattttggcactaaaatagactcaaatgtgtgctggagagaggcctaaattcagaaccttaaaaatacctttttgtgtcctgagatcttattttagataatattaaaaataactttccctcctaggcatcttaaacaagtttgatgttataatcctttggtgattttattgtgattcactatagaaattacctttttgagtggccgttttgaaatttagctttagaaggaaatggtataaaagccattgtaggctgaataaatgtgaattctgcttactcatcactacaggaattagggtagactgtctctttacaataatagtttcctatactcatgttcctttaaaagggggtgggggcattatattaagaagtcacaagctctgacaggggaattgcagaagaagatttcagtttaaaatagctcacagttcctctctgatttggagttttcacaacctacatggtatagcacagactgttctcttttaaattttgtagtagagtaggtcaatcttttcccatctttctgccacggaaagggcataaatatttccatcatcagatttaataacctgtgttagactcatgagtaattgtaaatggtgaaacactttcttcataaaaaaaataaaaatgagagataatgtgactcagtattattattagaacaaatcaccttaacccatagaaaatatttctttcctgcagcaataagtgttgagtatttttccctggggtctctagcatctcttgataagagtgaatattgttaggtccagcctgactggtggccaaggcaggttaagtttatgcaatgagtcgattgtggtggagatacatttgcaagaaatggaggagcagtcggcatttcacctctctccatcttgttcacctttctctctccctctttagaaactgggagcaaatattagagcttacatgtgctcagtgagagtggagggagaaagctgtattttcctggggggtctggaggccttctctgggtttattcattttcaaagtcactggtggtttgctctctcctgggtaggtggaagacattgctgtgacctcttgcctgctcagggcacactgaagtctagaagcaagggttggagttctctgagcctgtgagtgtccctattcaaaggtgctcctggaagtgtctccctaaaggtctttgatggaggaggctggtatttaattatttttttctgaagtgcacaggcataggcattatgggttattgtaaagctctaaatagagccatgagaaataaggtaaatccatggaactgggcaactattattattattattattattattattattattattattattttattattattattattttggagacagagtctcactctgtcgcccaggctggagtgcagtggcgtgatctctgctcactgcaagctcagcctcccgggttcatgccgttctcctgcctcagcctggcgagtagctgggactacaggcacccgccaccatgcccggctaatttttgtatttttagtagagacggggtttcaccatgttagccaggatggtcttgatctcctgacctcgtgatccgcccgcctcggcctcccaaactgggcaactattattttaggctcattattttttggcaaatggaaataaaaagactcctcccctatttttatgacttggttacttttaaaagaagtatgcaccggacaagctgtgttcttcagtggttcttaacggagggcaattttgcacccacagaggacagtgagcaatgtctggagacatttttggttgtcacacatctggttgggggttgctactggcatctggaggggacactcactataagatgctcaacaccctgtaatgcacaggacagctccccacgacaaagaatgatccagttcaacatcttcattgtgccaaggttgagaacacagacttaaatagctcagagtctagttaccgtaacatcagtactgcgttttttccatggattttagagtggtcctggagagagaggaggaaggaaaatgtcatgaatctcagttgcaattcctttggctgctaaaaccatagctggtgatgcttgtcattgattaactttatttgctattttctttcttttcttatgaagaaagggaagccaaatctgtgttccctcttttgtcattaagaacatggatgctcagggtgttcctgggttcctccagccatttctccctcaagcaattatgctaattagtgtttgatcagatgattaaattataatgtgattaatcctgtgtgctaaccgctctgaatgcattttctctcgcctggttgccctgtgcctgaagcacccttttctgcggctggcggaggcctgtttttcctgtggatgtggatttctgttttcaaagcactgcaaattctctttgttgcctggtaaaagggagaggggatatttttgtaacctgttctctcaggcaaaggctggactggagagacctctgggaaatattgaaaccgtagctagaaagcactaatgatttgaagatactagatgtggagaaacgcttgaagaggagagtgcagagacagctgtagtggctccaaagtccatgaaatctttttctctgagagacttttcgctgtttgccttcctttcccttctgagtgttgcctaagtctctgcctcttgtgtatgtgatggccccgggaggggtgttctcggtttattttaggtttatatttccttaaaaaggcacgacatcatctggttttgttttctgataacacagtttaggtttgctcttgcatgccgtgtactttagactgggtgattttttgaggtgaggttcgttaacttaaaatgttgatgaaatgcttcctaatgtaagaaaattgggactgcataggaaagaatgtgagtagaaaatatcgatggtggtgttgtcattgatgggcttcttctctaaggctgcagattaccatggctcattgtgtagtttgatgagcttagcagtgattgaatttttccttgcaccctatcactttttctccctttatattagcttaatggggtagtctggatacaagaaataagagcatgtagaatatgtgcagttttttaaatcagaatttgcctgtgttttgatctggctggaaacgatagcctcttgcgttcaagagcaggtcacacgatgataccatatattaccattccagcttcccgcatcctaagaacccctgggccacaagaattactcatagagagagtaattatctgcatagattgtcacataccccttcgaatattgtgtaatctccttcatagaaatgaaaatctcttggtttgctttgaagaaagatatcctccttgtaattatttccctaaaaaagaatgagggtaaaaggaaactcgtatgtattgggcatctaaagtgtgtggacacttgagtgaccatttgattcgcactcgttatgtttattagctacaatagtaatgatcataaaaacaatagcttgaatttatgatttattactagatgtgaatattgttattatgaccatcgtaaagaaggcatggttagacaatgtgctcatggtcacacaattgttgaatgacagactgaggactacgcctctgttcattctcagtcaaatgggtatttttaatttcagttttacagattgcaaaaccagggtttggaaatgttgactatcaggccctggtcaggtggcaactgtgatttgagaatagcactttgagcccaggttgtctggtgtcacagtctttaaatcttctcccaaatcaagccacattcattcatttgaagttttcaagctgaaaatgattatgttaaattttctttaaagagttgttttgggaaagtgaaagatcggtttttaaaaatcggtgtataaatggaaaattcatttacttttccatgtcagccatttcgcttacttaagttagataagtaagagacaggttaattaactcttacccacttcagaggtgcaactatttcatgagattgcattctgttgggaagagtaaaattggagaccagatgacagttatattacattcatattacaggatagaatctttccccaactctcaaatttaaatcatgcatctgtttttaagtacactctatttcatttgtcctgaactgactaccaattttctcaatgccaaaatatcagaatcaaaatatttttgaaattgctaattggaggctgaaattgtgagttttgtatcagtttgagcttttctgaaaaaacacccaaattagttttgttagtaagcgtctgaatcttattgaagctgaatcattttaccggaagtgtccatgggacatgcgtcttaaagagtttagaaaatactgcctagacatttcagcctgactgaaagctcttgtaataaataagaataagctatgcctgtgtgtgcctgtgtgtgtgtgcatacctgtgccacgctatggtgatattcttattactctctcacactgagttaaggttcaagccagctactcatatgtgatatatgtcttctgagaaaggacatttgccttctgtggagtgtgtccattgtccaaatgtgatgaaaatagaccagttctctcagagctcagagcttccctcggctgctggctgcaaggtggtggaactcggtttattgcctggttggcccctctgcaggatacacactgcgtggtgctggttggaatactgttctaatgaagtcaccatctgggtccactggttggtcccctgtcgtgacaattgccttcatcctgtccaatcagccacctcacaaaccttggccagggatcccatggagagtctgactacagagaaatttaaagatatttgtcttcttgtctgtggcctaagcagcctgaatttcatactatggtaatactgacagaatcacctgtttatggagtggtgaatgaacctgtttatagtaattgctaatattcattgagctcttattgtgtgccagaaactgtgctaagtgcttttttctaccatcccatttaattgacaaacaagtctttgaggtgcctgttggtattatttccactttacacttgcggaaattcaagacttacaaaggtgaatgcctttcctagagaaggcatacattgagccggggtggaagcaggatttgaacccgggcagtctaattccagaactcctgcacttgacttccaggctgtcttcctggatgaatgagccccagataggtcagctggtttctgagtgcacatactatttagagtggtgatatagcttggatatttttccctgcccaaatctcatgtccagttgtaattcccagtgctggaggtggggcctggtgggagacgtttggatcacggcttggcgccatccattaggagggatccttcatggcgtggcgctgtgcttcatgatagggagttctcttaagatctggtcatctaaaagtgtgtggcacctcccccacctactccctgtctctcttgttcctgctttcaccctatgacctgcctactcccctctcaccttccttcatgagtgtaagcttcttgaggctttcttagaagctgagtagatgccagcaccaggcttcctgtaaagcctgcagaactgtgagccaatgaaaccgcctttctttataaattacccagtctctggtatttctttatagcaatgcaagaatgacctaacacaaatggccatgcttatctggaaaactggaaatgtaagttatggggagagttaagaggagccagatagcaaacatggctttcttaagcttttctgaaggaagatgtgggaaaaaatgtggcaatatgagaacaatttgggagtctcagggttggtttgttttcatcccagcatttctggaatctcagctcattcctgagatgagaggctcagtcacgaaaacattgccaagcacttgtggcctctcccatgcaactaagcacctggtcatccccacttcccaacgtgcagcatgtgtcacccatcttttcatatccatttctatggtatttggattaaaaattaaaccctccaaatttcagcagacaacactaggtgaccaccacctgtctgtagtgatctcgataccatcacggatctatctcttgacagctgactccaacgccaacttgcttttcctctgacctgtttcaccaggtgctcacacctactcacccatgtctcagagactatagactttgtgatatacctgattatacagccccagcctatctgccattgcatcagagcagctgcacttgaccaaggagctctcgctgcacacactgtgctctgactggtctcattatgcatgaccacaaacctcgagtgggctcttagctctgccctcaatctacctcactgccctagttgatttctgtgtctgtgggaagactacttcacacctttctcacctccccaaacctcaaactccccttcctttcccagactctgagtcgataacctcatatgatttactgagaaaaccgaagaatcaagtgaatacttggactattccctgctctccaatacacacccacacactcaatttttcatgtgatcagcgtccactcctgtttttattgcctccctttcaccccactgatgatgggggattcagttataggggtggttgaacacatgaccctgggcagataaaattgacagcagtgttgcattcaagtattcccacagcccaggggagtaggacagggcaggccatacagagtgaactagcaggggctgcgggaagcagaccttgtagtaacaagaagggatggtggccgtgtgtgcacacctgtaatcccagcacttcaggaggccgaggcgggtggatcacctgaggtcaggagtttgagaccagcctggccaacatggtgaaaccccatctatactaaaaaactacaaaaattagctaggtgtggtggcatgtgcctgtagtcccagctacttgggaggctgaggctggagaatcacttgagctcagaaggcggaggttgcagtgagctgagattgtgccactgcaccccagcctgggtgacagagtgagactgtctcaaaaaaaaaaaaaaaaagagggtggggtgtcccctggttcctgagggaggatgtgattggcttatttggctgattccacaggctgacgggagaccgaagcccactactcatgggtaagcaggcactgtgcctggtccctatgagcggagtgccatttggctaggggactttatccatgacagctcatgggtgggggagaactagcaggtaagccctttgaggctcttctgaatttatcccgttcacagcaacacaatatggaaccttaatctcaggtcccacaccagacccatacacatgaccttcgctactgtgaccatggaagccctggccttgctcctgttgaaagctgaaacctccattcatgtccagaattccacatctcccatctgcttaaagactttgcccttgtatttatttttatttatttatttttatagaaacagggtctcactatgttgcctgggctggtcttgaactcctgggctcaaacagtccccccgcctcagcctcccaaagtgctgcaaatacaggtgtgagccactgcatcagtcctgcccttgcattttatctcagcctcaacttccccctcttccagctcagcatatcaacattctgttttctctctgttatccctaccactgtaaaacgtactaacaaccaccacctcccatcttgtcaccacttccttcttccatccaattcctctgatactttttaatagtaaaactactggaaagaattgagtatactagtgcttctcaaactaactgtgctgaaagatcagtttttcattttccaatctgttgcagcttgatgtgaggtccttacagtacttgcctcaaacacagcttgttgctcatgcttcttatcacatgagttgaacgatacacaaagttgcctgtaccgcccttcctgagaatggagcccactgatcacccccttgaatgttgcagcaacttctcagtttctgtgcttgtctcactgtagacaagaaacaagcagctggtctgtacacacttcgattagcgctgtttcaactcacctgacactctcatctttcagtctctgttgaacacacactgatcaggtcttcttcaccactccattgaatctgcttttgtcaatgaggctgatgacttccacatttctagtcttctttttctgtttattttctttctttcttttcttttttttttttttttttgagacatggactgactctgtggcctaggctggcatgcagtggcacaatcacagttcaccatggcctcaaactcctgggctcgagtgatcctcccacctcagcctcctgagtagctggactacaggtgctgcaccaccacgtccagctaatttttaatttttttgcagagatgggggtctctttatgtgctaagattgcaggcatgagccaccacacatgggccacgtttctagatttcctcatgttcactctctcagcagctgtgacacaacagatcacacttcccttcctgaaacaccttcacctggaccgtgcacacctcactctctgggtttccctctgcctcactggcttctccttctcagtgtctttggtgagcttcttccctctaattagactctaaatgttgcagcccactccagggattaattcttacccctctcttctcctctcctttcctctctgcttcctttcccttcccttcctctctctaattcctctctatataatttaatttaggtcaaggcattaaatgccctctctatgctgatgacttccatattcgtatctctatccatgatttcttctctgagctcaaatccagatcctgaaatccagctgcctactcaacatccctttacaaaactcacaggtatctcaacatttaaactctctgaaggaggccttctggattttcctccctgtaaccacttctatctcacattttggtcattcaaactgagcatcgctcgtccctcactgcacagaacagaaatctcagagtcgtccttgattcctctctgtccttcacatcttgtattcaaaccaccagcatgtcctagtgatgctactttaagaatctgaccatttcttctacctttaaattccttcaagctgcgttctcctttttgcctggactatcatgataatctgccaactcacagctgaatttccacccagtagccaagggatttcctcaaaatataaagcagattacatcactcctctttccaaagcctctcccttcatccccaaaataaacacagcattgcctacacctcaaaccccttccatggcctggcttgggctggcccaccccaccccctccacagagccatgctggccacctggatgtttctacagcttgctgagctggtcctctcctcagcactgcactggccgcgtgttctgcctggaatgctctaccctggccttttcccgccccacttcttcacttctttcagttctctgtccaaatatcaccacctaagagaggtctccctgaccacctgatctaaaacaaagtggcctccttgattgttcagtttctccttgccatgcttcaggtttctttgtggaagtcagagtacttaaaatcatatacttagaagtttatcatctgtctctcccaactggggaagcccacatttgtctactgtgctcacctagaagagtgactaacaggctgcaggtgcccagtaagtagttactgattgaataattaaaccaatgaatgttgtttaaagcaatgtatagctcttagggactggatgtcattgctgtctcttcagttctactttatttatttatatttctgatggaatgacagtatatctctgtgtgacaatagtttctgcatttggaagatctgcacttgtattttaattaaaagatcaacaagcattatgccctagaattctcaactctcacgcacccataaaagatataacaataaaaccccttacttaaaaaaaaaatctttgttgactacccatgtaatttctgatatgttgtatatactttgaggaatacaaagatatttggttcaaaaatttttgaaaatgtttactgaggccaggcacggtggctcatgcctgtaacccagcattttgggaggctgaggtgggcagattgcctaaggtggggagttcaagaccagcctggccagcatggtgaaaccccgtctctactaaaaatacaaaaattagccgggcgtggtggtaagtgcctgtaattccagctactcgggaagctgaggcaggagaatcacttgaacccgggaggcagaggttgcagtgagctgagatcgtgccattgcactccagcctgggcaacagagcgagactccatctcagaaagaaaggaagaaaaaaaggaaggaaggaaggaaggaaggaaggaaggaaggaaggaaggaaggaaagaaagaaaatgttcactgaacacctatatgcactaaactgtaacatccaagaaagcagggattttgtgttgcccattgtagtatcttcagttcttagaacaaggactgacacgtaagttgctccctccatatttgttgaataaataaatgagaaaaaaacactatattaacgactgtgcaagaaacaaaacaacttcctcttttctgggtcatggcaaagtctccaggacaataggacatgctcacagcttctaaaagggtgtacccaataatgaccaccatgtcggacatacagagaaagctctgcagtgtttatggaagcagaaaacaacttctgattagcctatttaaaaagggcttcaaagagagggggatttaaaaactttacttttaaggttgtgtatgcttttgactgggaaacgtgggcagtgaaaagattggcaggagaaaagaggaaaatgagggaagtccccgggtgtggagggagagacacagaattctatcaagctgctgtgcaaagtcatggtggaagacacatctaaaaatgggataggggccgggcgaggtggtgcctgtaatcccagcactttgacggggccaaggcaggaagattgcttgagcccaggagtttgaaaccagcctggaaaacgtggtgagacccaatctctacaaaaatattttttaaaaagtaagctggggatggtggcctgcgcttgtggtcccagctactgaggaggctgaggtgggagaattgcttgagcctggaaggttgaggttgcagaaaaccatgtttgtgccactgcactccagcctgggtgacagaagtgaggccagcttctgtctccaaaaaaaaaaaaaaaaatcaataataaaaatgggatagggagcagattgtggaaagatttgaattcaaatttagatggaattgaattgaagattcgtgtgttaaaatgctcatctctatttgagcaatcaatgcagtattttggttgccgcacataagagacattggagagcagagagaattggtggaagggtggccaagcaaaggctaattccacggtgccggggtgagatgatctgccactaggacagtgatggcggctgggtactgacctaggtgggaggctgggggacagagggagcccaatggggatgatccaagcatgactgctgataaggttgggtctagattatccccatggcggtgtctcacaatgtgagtttaccgttaaactaaagctgtggatagattttatagccttgtgtgtttaattactgccaatattgcctactttttttttttcttttgagactctgtgaaatttgcgtttctgcaaactatgtgccagaatggagtcattgacagggattttataacacctgatgagaattattctataattttatcacagcataacccaagagatgctgaaacctgactgcattgcaatatgtatggatcagagggcacatcctgaagggctaatcagcttcaatcaactcataactgacaagtttaatttcttctgttttttgtatttctcttgaaattaaagtatacaaaaatgtagtattgacagtgaatttgggtgaggtttcactgtagcaatcaccatctattattttacaaatcattgggatcaattttggttcctgttagcataaagctatttgggtttttagtaaccagaaaatgaagggttaagcacacctataaatatttatattttttgttatgtagtataacttggtatcacccaaatatccattttccctcattcatatcctgaaaaattttaagtttaaaaatgtgttccacgttgtgagttttgaaagccttaaacaagttgaattgagatttacaggattcaacttagtgtaactttgacctcaaaataatttacaattcatttcatatttcacatctgcagcctcactttttcgttgagcagcttaatggtttttttttatggtttatctgtttttggcctccttgtctgtcttcctttctctcctcatcttgcacacttattgacacacacacacacacacacacacaatgtatgtatgctaagattaagcattctttcttttttgggggggcggtgctggggggctggtgtctcgctttgtcaccctggctggagtgcagtggcacaatttcggctcacggcaacttctgcctcccgggttcaagcaattctcctgtctcagcctcccaagccgctggaattacaagcatgaaccaccaagcccggctaatttttgtatttttagtagagacggggtttcgccatgtgggtcaagctggtctccaactcttgacctcaagtgatccgcccgcctcggcctcccaaagtgctgagattgcaggcatgagccactgagccaggccgaagtgttatttcttataagaagtttatgtgtaaattctttgcttttgtacttattgaaaaagttatagttttgtacttattgaaaaactgaaaataaagagaagtagggtttacatattgtatatacccatctcaacgtgatacagattgtgaggaactggcactatctaagcagggtgatcatgatacagaatgttactaatgttattaatgaccgaagatgaaaccagtgtaaactcaccaatgggctttcttagaaggagagcattcattaacctgaaaatatttactgtgcttattttatgtccattgggaatatggaataagataagcacagtataaatatggtttcttagttggccatttcattaggaaattatgacatagataagtacaaagtaacaaagtctttttttttaaaaaaaaacagaggtaatataagctaataaaacaaggagacaaactgaataatccaatttagttagattataaaatgagctcctgatcattctaaaaagacttttttttttttttttttttttttttttgagaaaagatctcactctgtcacccaggctggagtgcagtggtgcaatcttggctcgctgcaacccctgcttcccgggttcaagtgattctcccacctcagcctcccgagtagctgggactacaggcatgttctaccatgcccagctaatttttgtacttttagtagagacggggtttcaccatgttggccaggctggtctcaaactcccgacctcaagtgatctgcctgcctcagcctcccaaagtgctgggattacaggcatgagccactgtgcccggtctttttttttttttttaacttttattttaagttcggggatacatgcgcagatttgttacatggataaacttgtgtcatggaggtttgttgtacagattatttcatcatccaggtattaagcctagtacacgttagttatttttcctgatcctctccctcctcccactttccacccttcaataggccccagtgtgtgttgttcctctctatgtgcccatgtgttctcatcatttagctcccatttataagtgatgacacgtagtaggtatttggttttctgttcctgcactagtttgctaaggataatggcctccagctccaaagacatggaaccaacctaaatgcccaccaataatagacaagataaagaaaaatgtggtatatatataccacggaatactatgcagccataaaaaggaacaagatcatatccttttcagggacatggatgcagctaaaaatgttaaatataaacatagaggagaaaggaagctttgtgaactgtacttcgggagggctttatggaagtgaagctgttgccacagaatcctagggaacatggatcagtgctgtcctgcagtttgagaagagggctaggcattgaaagcactgctgtggggtgtgtgtgtgtgtgtgtgtgtgtgcgcgcgtgtgtctgtgtgtgtgcatgcatgcacataaatctagagactgaatggatctgaaggaggctgaagagcaaaatccaggctgcagtgagaagcttttaaggactctcagagcaaagctgtgtgcaacagagctaaaagataaaatgaaaaatgtactgactcttaagttgtgaaaagtcaaaaaagacaatttgacaaactcaaaacagtgaagatgattcaagaaattagagtgtgtatatatatatatgtgaagatatatatatctatatatatgtgaagatatatatatctctctatatatgtgaagatctatatgtgaagatatatatatctatatatatgtgaagatatatatatatctgcgaagccctccccaactacagttcatacatatatatatatgtctggatatctggtttgggtacaaaaaacttgctgtactaaattattgataatatattttaaggcaatttactaagttaaaagcataataaattataatctattattgtgctctagagaagttattgcttaatgaggaaattaaggttaacattgaaacctgggaggttctgatgtttaagtgggcataaatcttgaatggagttaggctcagggccacactgggtgatttatccaaattcactcactcttgattttttgtttttttctttgaatttttacatggctatggagttcaaccataagataatttttttctgtaatacatatttatgaccctaatttaaaaaaattttattttactttcagttctgggatacctgtgcagaatgtgcaggtttgttacagaggtatacatgtgccatggtggtttgctgcacttatcaacctgtcatctaggttgtaagccccatatgcattaggtatttgtcctaatgctctcccccaccttgcccccactccctgacaggccctggtgtgtgacgttcccctccttgtgtccatgtgttctcattgttcaacttccacttacgagtgagaacatgcagtgtttggttttctgttcctgggttagtttgctgagagtgatggcttccagcttcatccatgtccctgcaaaggacatgatctcattcttttttatggctgcatagtattccatggtatatctgtgccacattttctttatctagtttatcattgatgggcatttgggttgtttccaagtctttgctattatatatagtgctgtaataaacatatgtgtgcatgtgtctttatagtagaatgatttataaccctctgggtatataccccgtaatgggattgctgggcatgaccccaattttttacctaagagctttttatagttctagctttttttagtcacaagcagggggcctttatttatatatccctacacacattatttttctccataaattgtcaacttcctgccttatcccattcctgatgatgatatcctgttcttgggaattaaggccctagagccctagaaccatcaacagttagacatggaaggacctttgttaattacctgtcaaaatcttctatttgaaagataagaggggagtgaggatcaaagatgtaaattgacttctttaatgaggcacaatatgagtggaatggagctggaacccaaaccaagctggcctatctcccagctctagacagtttccatcatggcaaacatattcatgagaagaatgttggaagaaattagaaattcgcatataagccaatgcagatcaatatatccatgctagattgcgtgatttatcacaacagcttggcccacaatgatctcgttggttgactgagatgggccttttttacactcaaaatttgtgaggattagtaattatatggcattagcattatgttcctaaatttatggctcagtgaatgctaagtatgcaattgggaacgtatacacaaccattatgtgtttggcccttgttgtttcctgagactcaacatcttatagggtgaaaatccaataatgtgttttgacgacatagactgcccccactgtctggggaaggttcacatggggctgaaaagctcccctgcctgggtgcagcccagcacagtgctgtggtttgaggcaatctgtgttcaattacggtaaaatgttaaattagctgaaagagaatttttctggtcacttgagtctgccttttggactccattaatcattcaatcattaaatcatttatattaaccctttctaaccagtcctaaaataatcagctttgtgttccgtgtttttcctcagttagattttcttgggcaaatagccctgggccccagtgaagaatccagcctaccttaggtgctcagtcagtgttgagcaaatgggtggatggctgttacgcaaatgggctccgtgtagggcttattagacctcaaatcctggtttcctgtcatacttcaacaggaaatgctacatttgtacttcagatctaaattttattttaaagccagaaaaagctctttttatataaaataattatgtggttattttaaagtaacaatgtctcattccaaagaccatctctttccttttttggttcagctgtgttttagacattatctaaatttagtcgttctcttagattttatcacatcttcaaaaaatgctattttagagtaaagaatatttttaattgttctgttcttaacctcagtgtccatggagggttggagaagaagcaacatatatgaagctgaagattgatttctaaaccttcagttaacgttggctttccaagagcaaatgctcaagcgtgggataactatcttatgtgactttgtctttttttttttttttttttttttttttttttttttttgtgagacggagtctggctgtgtagcccaggctggagtgcagtggtgcgatcttggctcactgcaagctccacctcccgggttcaggccattctcctgcctcagcctcctgggtagctgggactacaggcgcccgccaccacacccagctaattttttgtatttttagtacacatggggtttcaccatgttagccaggatggtctcattctcctgacctcgtgatccacccgcctcggcctcccaaagtgctgggattacaggcgtgagccactgcacccggccgactttgtcttttttttaaaaagaaaacaacacatcgcatgggggcggggtgcctccatccaggcagtgttgcagggacaggcggatgtccctttaccacatcgaggcccaaggagctttcatcaccgggagcttcttttttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaccgggagcttcttgaagtgatgaaccacgcagtgttatattccttttaccttctactctgtcatataaatgatgacaaattgcctagctgtaaatttgaaagtccctaaatggcatttttgtcaaagccttgagaacaaaatgcttactcggagagatttttaagtcttgggagacggggtggcggggagcaggcctaattattatgcatcatggcacaatgcattatgcatcacgcttgcttttctgctttttaaacacttgttatggatgatgaaactaatttaaatggacaaacagggcgctctcctgcacattactcctgtgatgtcatattcttcttccaggggatttcatcctgcttcccttggaagtcccccagacatgcacattttaataagacactttaataattagcttagagataattgtcagtcaagggaaaataaccttttatcataggtgccttgaaagtggcctgttccagagaagaaacaagcgatctgatttgcacttaagcttgcttccctttccctcctggcatttatgtggaataaaatactacaaacgggggagagtgtaaaaaaaggaaaagtgtgggtgtggaaggggaagccggagctgtcaaattgttaagacaaatggggcttagagaatcctaattaaacctgaaattgcttagaaacaggaagtatgtattcctaattgttggcaccaaaaaaaaaaaagaatctaatttactgcatatctttaaataagaataacccattatttggctgaatgagaattcaatccttacctattgaagaggtgaatggcgtgattttaaaggctatgaaattcacctccaaagttcatcatcagctttagagaatgtcaaaaaagagcgagctcgaagccatgtgtagaattttttttttctttttctcataggtgtattctagctttattttggggaaactttagtctattgagacctttagaaatattatttgggtctctaaaaaataaatatgggcatatagtctcaagactcaacagaaaatagattcattttgaagacaacccagcagcgttgcttaataagaaaaaaaatgtatccccttgggctaggacttcagttcctgggaggatgtgaaagatctctattgcagatcgcagcaccagtctttcctcctgttattgtatcttttgatgcagaggatcaaccacccctggtttttgttgttgtttttattgagacagagtctcgctcttgttgcccaggctggagtgcagtggtgcaatctcggctcgctggaagctctgcctcctgagttcaagcaattctgcctcagcctcccgagtaggtgggactacaggtgcatgccaccacacctggctaatttttgtatttttagtagagatggggtgtcaccatattggccaggctggtctcgaactcctgacctcgtgatcagcctgctttggcctcccaaggtcaccccctctttttatttgggggtaggaagggcatctagcatcccgacacctcaaattcatcatcacatggtgcaggacagaactaaggacaaattaggaccctttctgagcctttgctcaagcttcaaatcacacttcttctcgtttgtacagcacttatagcactttgactttcatttatttaaaaaacacattgaatatgttatccccactttttagaaactgattttgctgttttgacattgtttctctagtagacgggaagggataatagattggaagcaggaactgtggattctgcctgtggttgcctctctgactttgggatctcagggatgtcagccacattgcctcatctgtggtgacaaccacaatggtgacaggtggaatcatgatggctgcaaactactgagcactttctaaatgccaggcactgtgtaggatctttcatcatcacatctcagtctcactgtagtcctctctcccctttacagatgagcaaactgaatcacagaaaggttgagaacattgctgaaggtcactagaggtgtgtgttcagtttgaatgcagatcacctgacttcaggaacagtatgataacctaaatccctaaactcatatctcccatcctgtctacctcacaaaattatcgtaaacaacaaagcaaacggccataacttaggaaaaatactttgaaaacaaggaagcacaccctgggtgtgtgtgacacttccattattatcactttctcagcatttcatctggaaaacggacgtaatcacagttgccctagaagacagtggtgctcattacatggaagagatttgattagtggtggaaaattttgtcttttaatttgtccagcagagggttggtgccagctttatcctgggagacaaagggacctacatttgcttatatttgctgactaggttcttgtgtctgtgtgaggggcagcctgcctttaaggcattatctgtgtcagcccaggttgagggcttagggatggaggctgctggtggaaacaaatgagctttgtttagggggaaaatagccttatctcgtggcagtctgtcccttcctatttgttctgagaaaatgaccaagtgataggcccttcatcatgtacaaacactctttagattggggttaccttttttctttgggaactggaactaacaaaatggcaatgacctgaaggttgagaatgacttctcctctccattcagcccctaccctgtcagctgtcactgcctgcatcactgggctgcagcatttcagcatcttctttctgaagcagatcaaatcatgcttagaaaatttgatgtgtggcccttctcaagggcttttcttcacttgtttttattttgaacttgtaaattgctatcacattttcaaacactgcaatcacctcgctaattgctgtttttcatgaataagaatacaagatcaatggccttttcaatattttcctttaccgtgaggtaatcgaaggtcagtacataaagctcctgacatttcagttacctgctcttcctcctgttaactggattacctacttgcctcttgtggttggtcccagtgtttttatttctgcctctgcaattgtcagggtgtggttccaagtcaatcacatctgcaggtcaacgtctcatcttcgttttccattatatccttttcccgctcttcttcatgattaactaaaaccccttgacaacaatgatctatgtatttgtcaatgttgctgctaagcctttagcatcaccacggtagagacagacagctcccttcctcatcaatccttgtgtttatgtgagcatttaaaatagctattagatgtaacttagaaagaagcagtatttcttttgtcacagcacatcttttcaagagagattttgcacttctcactttggtcctttctctactacgctaaggtgtgggacttcacacagattgttcttacatttttaatgaacaacaatagtaagcaattaagaattttagcttgagattaaatattgaaaaatgtcactaaaagagttacaaaaagtgcaactggacctgtgcagagccagagagtctgcatggttctgcggttcttcatgcgcaggagaattacacagttggcacatcccagcccatgctggaggccacaaataaagctgttgtttagtatgctccagttgcattttggtcacatgtgcttatattaatgcctttgctttctgcttcctcttgggtattatgtggttgcttggctgcaacagtgaattccagctgcattgatgaccactggaaaactgcaagagaccaaaagattcagggaatcgagcctgcctcatacccctcataaagctggaaattaactccaaaagaaaccgtcaaaactggctgtgctcaggggctcatacctgtaatcccagcactttgagaggccgaggtgggtggatcactaggtcaggagttcaagaccagcctggccaaggtggtgaaaccctgtctctactaaaaatacaaaaattagccgggtgtggtggcgggaacctgtaatcccagctactcgggaggctgaggcagagaattgcttgaactggggaggcagaggttgcagtaagctgagattgcgccactgcactccagcctgggtgacagagcgagactccatctcaaccaaaaaaaaaaaaaaaacaagaaagaaagaaagaaatcctcaaaactatacaaatatatggaaatcaaataatctgctcttgaataatcattaggttaacaatgaaatcaagacggaaatttaaaaattctttgaactgaatgataatagtgacacaacttgccaaaaccactgagatacagcaaaagcagtgctaagagggaagttcacagcattaaatattaaatgctgacatcccaaagcctgaaagtgccaaatagacaatctaatgtcagacctcaaggaactagagaaacaagaacaaatcaaacccaaataatacccctgtcttcatataccacagttatttagattaatcaacatatgtgtggtctcataggttctcttgcccaaccatggtttttaggtcagagagatgtgggttcaaatccaatcaactcttccctagccttttatggaatgaaatggtgtttcatttgtgccgttatcaatcatcatctctattatactctttaggatatattaggctgcacttttatgcgcatgagctttttgtatttctcctcgtatttcaaagccagagttctctgaagacatgtcgaaacccatttacttatctccctgcctatactcactcaacacctggtgaatttccatctgccattcctttcactaaaacaatttaccccaagatcaccagtgacatacgtattgttgaatttagcaggcaattttcaatcctcacagcagtttccaacactggtgaccacaatctctttactgaaacaatctcttgctttggcttccaacttcccactttctccctccttcttttatttttctagtctctgtatcaactgggttgtgcgtgacctttaagtgaattccttaaagttcaaaccaaggctctcctctatctttattctacatcatcttctagaatgataaatgtgtgcccataactttctatttcctactgtactttgagcttcagacctatatgttcaattgtctggacatatccacttcgaactctcaaggtttcttctaaagctagtaatcctaaccaagttccatcttctccctctgtggcccacaaatagccataccgtgagagtgtgggtagtcatggttcacatgtatccaaaaagagagcacaggtaatggaagggaatttaggtgtcttgggagccatggtgtgatttcttgatgagagctgtggctcaggggtcactgtctgcgtgctgggcacagtgtgacagtagaatgcatggactcccaagctgaagatataagtgctgggttatctaggaagacttccttcagacactggtgtgatggtgctgtcattgacctgagtacctgctgcatggaaggggagaacatattcttgctaagactgggtatttgagatgtggcagtttatgaggtcagatggtaacgatttctggctctcagttgatttgctatatttttctgattcaattctgtttctctggttatatctgttatattcctgctctcccttacctgtttcctcacatctaaagaatacttcactcttcacttactcactggtattttccctgtaaacctctatgccttctcctgatctattgtttatctccttgtaagctaactcttctactctccaataccaggaagatgggagatgaagaagaaatattctctttttgctgaagcaaggatgcctcaattggagaacatagtgagagtgaatcacaacctaaaggcactaagaagtgagaaaggccggaacagacaccaaagttgacttccagtggtcccaggtgcctatcccatatgggaccccataggtcttcaacgcaatctactcagcctggctcagcccacagagaggttctgtgggagataaagatttctcaaaaaaccaaaatgagaaagaaaggctaggcctggaaagtgacccaaagctgagttaactgctctctcagcctccaggttacccatgaggatttctcctttctgtctgcatcagcctttgttctgtctttgcagactgcctttatctgcttctccagcatggaccacctggttctgctgctccagggcccccttcccaatttctggtggaaagaatctgactccacgtgcgcccattgatgggtgaacgttaaaactctttagaacacactttcttttccagaattcatgttgatgaacttgtaagaataattaaatcaattaaaattcaacaagcatcaagtatttggtaggttatcaggtacttgactgagtcaattcaggatttaatctcaacaggtaaaagcttaaaaaggaagcaatcatttgaattaatgtttgaaatgcagagccacaaatactaatttgggggttctggctaatatataacaccctcgaaaagtctgtttgtatttaaatatcacatggaggctctgtttcttgctccttgactctgcacgctgtagcatgaaagtgatgacattggactctctgtcttctctggcagaagcccactggaaaggatgtgagaaaccctgactagggacacactgagccttcccatattatttaatgacagtctgtgccagggcctccattaatttaactgaatgaaatattcctatctggggtttcaatagcccttcactgagtatctcctatacaatgtccccatcatggtgtagcctctcattgcaaacatacaatgaccccaagtgaaaaaattatttttataactatagcattttttttagagacagggtcttgctctgttccccaggctggagtacagtggcactatcatggttcattgcagccttgaactccaaggctcaagcaatcctccatcctcagcctcctgagtagctgggagtacagtcacacaccaccatgtctggatagttttttaatttttattttgtagagatagggtcttgctatgtttcccagactggtcttgagctctcaggctcaagcaatcttcctgccttagcctcttgggtagctgggactacaggcatgtgccaccacatccagctacaaaaattttcattattacctcagctggacaagcgagaaaactgaaatccagggaggttggagctgggtcagctaattagtgatggggccaggatccaaacccagatctctctgactcaaaagcttaaacactctacccaaccttcttgtgttcctggtttaccagactacccaccaggaacagactcgggacctactgggttaaggagaacttctaataaattcatctctttttacatgacttctctcccccttttcagcaaatttctggagtagaaacaatttacattcttctaagataattttcttccccctgaagattaccacacactccttcctgtgcacagacctgagggtgcaacgttctagctcctcaggaacttctgagagggtgaatcgcagatttggatcagggtgaaggctatgtttgatcaatgttgttccacaaggagatgcacagtaacatttagactacaaggaaaagcagctccagccctcttctttgtctgcaagttcagccacatgggctgtaatctcatagtttcaacagaggggcctgctgcctctggccttactgggcagcaggtggtggggacggctgttccttctggagcgacactgccatctcgcctgaagtcaggaggcaatggtgcaatgcactgctaatatttttctcctgaagactgatgacttgctggatctgtagctaaatgtcttgtctcattttcacagccacgtcatcgcccttttcctagtgcttgtgagtgagtcacgtgcaagggccatctgggaggaagcgttctgttaaacctttctttaaagcatctttttgatgtcctgggaaatgcacctgcccactagagttcaattcagcaaataattgttaaatgatcaccataggcaggggacttgctatgaatataacaaagatgaaaatgccagttgacagaagcatgacgtctcctagaggacccagatccaagtgaagcaagtgcagtccaaggcagggcagggtctaggctgacagtttacaaggctcagtttcttagccacttacctacttctgaaatgcattcttatatgtttaacatctttattgagcgataatttacataacgtaggattcacttattttaactgtatgattctctgattcttaacaagttcacagagttgtacaacaatcgcccttttagaactacccccaaaatatctctcatgcctatttgaagtcacttcccatccctgctttgaagtcccacccccagtcaacagcttctgtctactttctttatagatcggcttttcctcaaattaggatctgcttctggagaactcacaccaagacacggccccttgtccagtcttatgagctaccagtctgtcctgggacatggtggcagctgttgtctcttgcctttatcgtggtggtggctgtgctgacctggggaaccctggaacttctgctatcaatcccaacaggccagagctaggtggatgctctggtctcatctcattggatgagacccctgtcctgccctaacagtcaggacaagggtctaatccaatgaagaggggcatcaaagattgttcaagaacaatcagattgaccatgggaatgggtcagtggtgagcatgtaggatagtctctggggtagaagttagatgctaggcgcaggttaaggagcctggagctgatggtccaggagggttatgtcacctaacaaagcagagagtgtcagctcatctgcaaatggcgtttgcctttggggtaattccagcccacactgaatagcaggtccatgtgtaatctccaaagtcttcttcaactttatgagaatgggcctgggcatggtggcacatgcctgtaatcacagcactttaggagggcaaggtgggaggattgtttgaacccagagtttgagacctgcctgagcagcatggtgaaatcctgtctctacaaaaagtgaaaaaaattaggtaggtatggtggtggtgcacctgtagtctcagcaactggggaggctgaagcaagaggaacacttgagcccaggagattgaggctgcagtgtgctgtgatcatgccactgcactgcagcctgggtcacagagagagactatgtctcaaaaaaaaaaaaaaaaatgatggttgtattaacccaaggcctacttagaatctcaaagacctttctctctctcctcatctcctgccagagcttgaccactctgtggttctagctgcacttttatcacttctctgttctacttgcaagatggcttcttttcatttttttgtgaactttgggtctgtatgttgtcagcaatcttcagtgggcatttttgggcctcttggtcttcttgtggtctggtgagtagagatgttgactgatacaaggacagtggaattcccccattgcttcaataattttaatagctgaccctttgaggaacattgaagctggatggtcattcagacttgtcccaaattgagttgggctccagcaacacccattgaccagtcattggatgagtgatgtctttggggaggaggcgtctttggttgaggtcatagaaggactcagctctgaattctttgcaaacaacacactcagcagatgaggagatgtgtacttaggcccagaagtaggaatctggacagcagaccacagtttctactatagacaacaaaagccacacagtgaacatggagctaaaagtcactgtggttcatgaactataatatacctcacaatagcatgctataatatgtaaaaatacccctcggacagataagagaagaaggtggatagaaattcaggcttttggcccttttcaccacttcccaaccctcttccctttttctctcttctcttgtctcctgccagagcttgaccactctctggttctaactgcacttttattacttctctgtcccacttgaaagatggcttctttttattttgttatgacctttgggtctttatattgtcagttgctataaatgaataaaggctttttccttcttagtgtgttggtgaagaactaggagtattgcactcactgatcaggagggaacaggtctagggagtgcatagaagctttccaagaggagtggacaggaagcctgtcctccccctcgccctccacccccatcccgccccacctcctgcgaaggcaggaggaccatgaacctgcaatttggctgatggcagttaaggggtaatcaaaagtccaggcataggaactggttccttagtgtccatccaaagcctcaagaggctgacctggaaggatgcaggtgtgagaagccatgtgtggatcccaagtttaaggacatagatgttttccttacagaaatggaatttggacactatatggttacgtggtcagccagcaacagagttcaataataataaacccctaataaaatatttatgtttttccttatattacgtttctcctatgaaacacttattgattgattgattgattgattgattgattgattcattatactttaagttctgggatacatgtgcagaacgtgcagatttgttacataggtatacacatgctatggtggtttgctgcacccatcaacccatcatctacgttaggtatttctcctaatgttttccctcccctagcccctcacccccgataggccccggtgtgtgatgttcccctccccatgtccatgtgttctcattgttcaactgccacctgtgagtgagaatatgtggtgtttggttttctgttcttgtgttagtttactgagaatgatggtttccagcttcatccatgtccctgcaaaggacatgaactcatcgttttatatggctgcatagtattccatggtgtatatgtgccacattttctttatccagtctatcactgatgggcatttgggttggttccaagtatttgctattgtgaacagtgccgcaataaacatacggaaacactaatttcttagggtgatgaaactaatagaaacacagcccttgaatgtatttgtacatattgtagcattcacaattttttcagacctcataattgtcaaaatgaagggtggattttgagtacctctaggatttggaaataaattatgtgactttttacccaaggtcattcaaagacgcttgtgtagcaactctatatttgtattgcaagagctagactggaactttaaaatatcatcagatctctgtcaggtaaactcacagaaatgagcttattggtcaacacacttttttttgcatcttcagggtgccaggcactgggagaatcggggcaccacagatctgactccccacttggtggagctgacagtaaagcaatcacgtcaataatggcagcattctgcagcatatcaacagcaaagtagaatgcaccttggaaggccacagtggggacttaatctagcttgtgggccaggcaggaaagaagggccagcctcatagtgagaaggcttccagggatagtaaatcatgatgtgctgaaggatctgagaagagcccagcagggctgaggtgtagcaggcaggggtatcgcagtaaatccccagcaggaaacagatggcaggctcatcttagaaaacattgtgtttaggccaggtgcggtggctcatgtctgtaatcccaacactttgggaggccgaggcgggcagatcacaaggtcaggagatcgagaccatcctggctaacatggtgaaaccctgtctctactaaaatataaaaaaattagctaggcgtggtggcaggtgcctctagtcccagctattcgggaggctgaggcaggagaatggcatgaacccgggaggtggagcttgcagtgagccgagatggggccactgcactccagcctgggtgacagagcaagactccattaaaaaaaaaaagaaaagaaaagaaagaaaacattgtgtttaataaagggaccatttactatggtatgggctgagtgtcaggacaacaggctagatggtatagggctgtgtgatgatggacttgccaccatccttaggcctggaggggtcaaggggtcatggcgtaattcccagaacctggaaggggaaggaaactttggttgaccaatggaacaagctaagtaggttcattggggagtgagccaagggaatgagttactgagtttactcttctactgccttccagtctcctgtctggactcctgtggccctgaacacaccaaaagtcagagggcatggaatctcactgatgtcatgattactggtcagcctcatgagccagaaggcaggatggagggggaatgaacaaacagaaggaaccctcacaaaacagagagggggaaagagagatagacatacaagagagagctaggaaagttggcagtggccagattttaagagatacttggctcatattaagattaaggtttacttggaagtcactgggcagtcatctgtgtgatcagattattataagaagagaagtagcagactggagggtggatttgagaggagcaagggtggattctagaaggccatttgggaggtcatgacagctccctaggagttggggggaagtgagctaattcaagaatattagaagagtctcgttcagacagctgagtggacgtgcctttcactgatttaggaaacattagcattagaccaattatgggggtggggaaggagaaagcttaagtgcaggtgtgatcatggtcagcttgaaacacctctgaatacaattgggtggggtacaatgtagcagcgggaagttaagtctggagctcagtagatagtcctagatggaggggaatgttgacttatagatgggaatttagcaatggatatagtagaggtctctaaagagcacaggtagcatgaacagatacagaaggcctaggacagaatccataaaaatgtcaacatttcaggattgtgcagagacagatgactgagtaaagaagactgagaaggaacagataagtagtcgaaaaccaagtgggcagggcaggaggcaggttagggtgagttgcaaagtggctgagaaatgagaaaatgaaaccgtgggggctctcatcttctccaggaaggtgtgctgggaacggggaggggagataggggctagcaggcagagggtggtaggagcagagagagccctgctgggaaaggaggacttgagcctacctaaatgatgaccagagtcagtggagaggcaatggcaatggaaagaacaagggtccaggaggaacaggataatcatcagggaaaggttggaatgcggaaggcaaccaaagcatcctgcagagcgtgcattttgaatttctgtgatcctctggaaaaacaaccttctgtgcttcaatttaaaggaaggtgcatggactctgtgctcccctgattctgaaccacactccatcagcaaggccacatccacattcagagctccaggaagcctcccctatccctgtggacaggacttggggagtggccttgtactgcacaggtcactgtctccattctaacctaagtgagggaagagtggattggtccctggagtgtttacagacttggtgctgatggaggggtggtttaaaggatttttagctatttcccccctttctttattaagcagaagagaagactgggtcctgagagtaaagagtctgaggcttgagtaggttagagaaggagaaatggtcattttgtagagcaggagaggggatgctccttagagacactgaaggaccatttaggctggtgacggcaaatttattgtgacacaaatcttcccagctgtgggattttccccaacaacactcaacggtccagacacaggtataaaggtgttttttttttccccattcttcccttcctcttttccttcctgtctgatctatccaagttggagttcattacccacagattctatacataaatgccagtatattctatatatactaaagtctgtagattctagtaattcctaactcaccaaccaactacaaggtttaacaataatagaatcacacatatgtcacctttctaaatcattaacctgagagacgaaagagaagggggagtctgggggcccgagatcagtgactagagggtgttgcagcactaaaacatcacacgattgatcagacctatcatggctctttcactttcatgaacattttgtgttttgctttaacagaatttgagtcactcctataggtggctttagtggtccttccctgggtgttttctcagacttgtggtgggtaatggggtagcatatgtgtgctcacgtgacagagtggagttctcatcatttcactgccttcttggcaaacagaggcaatgagaacgtcaaaggcatcatttgcatttgtaaagcaaaagccagtgatcacatctgtatctaccatatggcagatgttccataattattttgaaaaacatatgagatttcagctgtgcagcacttattggagacttgaggaaagaaatttaggggcaagaaatttaggaatgagtattattttcctcttagaaactgacttctctgacttaccctaaatttagtacttccaaagagaataacagattttcatcattgtaaaatatcagcaaaaacagaccaaagtgctgccataaggaaaggaattctgttagtggtaccttgtctgtctagttgtgaggtgtggtcagctgcgtaatgctgtcacttccccaggatatccatgtctgtattagtctgctttctgttgcttgtaacagaattctagaaatgtgtaatttataaagaaaaggaatatggttcttactgttatggaggctaacaagtccaaggtcaaggggccacatctggtgaaggtcttcttgctggtgaggaccctttgcagagtcctgaggcagcccaggccatcacatggtgaagggctgagtgtgctgctgagatttctctctttctcctgttacgaagccacaaatgccactgctgtgataacccatgaatccatgaatggattaatcccattgtgagggctatgccctcatgaccaaatcacctttaaaggccccacctcttaatactgccacattggggattaagcttcaacattagtttcagagggagtaaacattgatatcataggcttttgcccctggcccccaaaactcatgtccttctcacatacaaatatatgcaatccatccccataaccccaaagtcttaacttatccccacaccaactcggaagtcgaaagtccacagtctcatctgtgagtctgtgaaatcaaaacgggttgtctactttcaaggtacctagaaagactcacagatttctattttcaaagtgataaataggcaaaaagaaaggcttaactagtcccaaccaagtctgaaacccagcagggcagacattaattgtaaagcttgagagtaatctcctttgactccaccttagcctccgagacactggggtgggagttgggcccccaaggcctcaagcagtcctgtccctgtggctttgcttggtgtagcccatgcagctacttctatgtgctgaagtctggtccctgaagctgtccaacgtgggcattgcatgctactggtgactccacagttttgggatcctggtggaggtcctgcctctatggctccattagatattaccctggtaaggactctgcagcagctctgaccctacagttacatacagcattgctctagtggaaactctttgtggtggcaaccccccctgtgacaagtccctgcctgggcccccaagcttttgatgacatccttagaaatctgggtggaggctgccaatcctctacaactcttgctttctgcaaacctgagaattagcaccacatgcatgctgccaagagcctgcagaattagcgctacatgtatactgacatgtgtattccttccagagctgtgccacaagccatacctagggtctcttgagcctaactagggcagttgtggagcaccgttctggagtgcaggaaacagagtcctctggtggccttgggcactgagcctatggagggtgcccttggtctagctcctgaaaccattctgccatcttaggcctctgggcctgtgatgagagaggcagcctcaagatctttaaaatgccttcaggatctcttttttctgctatcttgaggaaaagcacctggctcccttctattcatactaatatgtttagcaaatggtctctgagctacacccttgattttctctcctgaacacacttattaacttttcacttggccaagatgagagcttttcaaatctttctgttctgtttctcttttaattataaattatgtttttaaattattcctttggtcccaaatatcagcataagcagccaaaagtaaccatgtagctccttttatattttccttagaaatgccttgtgtcagaccaaggcagggggatcacaaggtcaggagttcgagaccagcctggccaacatggtgaaaccctgtctctactaaagacacaaaaaattatccaggtgtaggggtgggcacctgtaatcccagctacttgggaggctgaggcaggagaatcacttgaaatctgaaggcggaggttgcagtgagccaagatcaagccactgcactccagcctgggtgaaagaaactccatctaaaaaaaaaaaaggagaagaaagaaagaaagaggagtttgagaccagcctgaccaacatagtgaaaccccgtctccattaaaaatacaaaaattagttgggcgtggtggtgtgtgcctgtaatccaagctactcaggaggctgaggcaggagaatcacttgaatctgggaggcagaggttgcagtgagccgagattgtgccactgtactccagcctaggcaacagagtgagactccgtttaaaaaaaaaaaaaaaaaaagaaagtaagaaagaagaaagaagaaatgccttgtgtcagatatcctagttcatcattcttaagtttggccttccataaagcccttgggcagggacacgcttcaaccaaattatttgccaatttataggaagaatggcctttactcaaaatttcaataccttgtttttcagttctatctgagatctcatcagaatggcctttactggccatatctctattagcattctggtcaccaccatttaaccaattcctaaggagttacaaacttcccttagttttcttgccttctaagccctcaccagaatccaggctttttctagcctgctccctcagcttccatcctctgcccattacccagttccaaagccacttccacattttcaggtgttcactatcatcaacaccccactcctggtaccaattttctgtcttagttcgtattgcttataacagaatgcctgaaactgggtaatttataaagaaaagtaatttatttcttacagttatggaggttgagaagtccaaggtcaaggggctgcattttgttgaaaggtccttttgctagtgagggactctgtaaagtcctgaggtggtgcagggaatcatatggtgaggatgcttagttattgttcaagtctccgtttttcctcttataaagccactaatgtcactcctgtgataatctattaatccactgactcgttaatctattaatcaataaatggattacctcttaaaagtccacatttcaatattgccacattggggattaagtttcaacatgagtttcagaggggacaaacattcaaaccaaagcagtgtactgtctccaaaacctgtaaatgctaccttatatggctaaaggaattttgcagatgtatttaaatttaggctcttgagattagaagattattttggattaactattaagcctaatgtaatcacaagaatctttaaaagagaaaggcaggagatcagaaggatagtaaaagatgtgatgatggaataagaggttggaatgatgtgtctctcataagccaaggaattcaagaggtctttacaagctgaaaaagactttatgaggtggaaaagctttacaagctgaaaaagggaaatcagatattccccatgttccttcaaagggagtgcagcccagtttatatcttgagtttagttctgtgaaattgaacttggacttctgtcctccagaattgtaagagaataaatctgcattgtttaaagccaccaaacttggggtaatttgttatagtggcaataagaatctaatactgtagaataatttactttgagttttttttctctgagtttcaccaatcagctattccaatgtatattcattattgattttcctgcatagggaaggtaatgtcagcaataaatttgagttaatgtgttagctctcaatttacctattggcaatatagattcaaattagagaggaagcatcacctaccccaaagccccagcaatctagttcttttaactcatttcactcccagagtaaaacaggtattttggtaagggaatcactgatgttacttacaaacacaggctctcaattaaaaaaataaaattttctttttggtccaagctttctctttacacacctcaataccatcctttgcctacaaacttaactgtggatatctaaaaatgtctttatagggtaataacatttttccaaaagtcagtagcttaattttagaagtaaaacattttaatggcttaggctatagttttatagcattgggaatggaattttcctgtttttatggtaaatttgtttatctaaattgttctaattttaatctctttaattttgtatgacctttattttatttttaattgaagagcaatatatactgaatgggtgaagtttgtaaaacacttgaaacacacaaaaaagcaactcttgtagttctacaatgtagagagatactgctaacagtctggtatgtcttttattaaacatttacaattaggtgattgttttattctttttttactgcttcatgaacattttcttcacatcagtagacgttcttccatattacacttataatgacaacatcctagtttatcgtatgtatctgctactattagctgatcctctactgtagattcaggtcattcctgaaatattattattgccaattcatgtgctttgctcatttcttttttggtgtgttatttgaaaaataggtttgcaagcttttataaatgctaggcttattaatttttaaaaggtatgtataatcttcaaaggtcattatttgccttttaattttgtttatggtgagctttattgatatataagcattaataaatttcatgcaatcgaaactacttggcattttcatttagggtgtgtctgtgatgatttgtattctctttttttttacagataggttttcttttgtcttgatggtatactggattttaactcttttcttcttttagatcaaatgcatatttccttcttcgtggtggagcagtggtgtttttagtccttaactaaccacttagcttattctgtattaagaacattttttcccacttagtatatttttgaccctaaatctgctggctaacttgatagtctgattcatcttaaagcggctccaggctgaattcaattacaaacataaggatagtattactatcttctgtaaatatgcacatacttacattgtgagttaaatacctaaaaaaagtaatgtgcatctaatgaaggatctttttttttttgtcccagatgacaagataaaattcttagtacatggtttccatttttcatattttggtaatgtccccactattaacaacataaactgataaattagaaaacaccagatccttacaactgtattaaatttgaagaaaaaaatgatttctttctatcaaggtagagaaaaaagaagctgaataagctctgggtttctggaatgtctccattcagctctttctctgcttatgttccaaacaattgcataaaagcaatcccaaacaaatgtttatagggctgcactccgaaataaagataatgaattctacataacaagtacactctttcccctggctgtttgcatttaaaatgtacattttgcagtaattttgatgacttcattttgaagcagttcttaacagacattttggaaatgtctcatgtcatgaatttattcataaaccagcctgtcaaaaaccttagtgttcactggggagaatgtgtctcaaatgcacaagtggttgttccacctacatcatccaccatcttgaaatatcattattcatttccattacttcttggatgttctggttcactgctactgggtttcgcaacagtgtggagaagagaccatgacattgaattaccggctaagcagcatccataagtgttatattcctcccttaattatgatgagaacttgtgtttaggaagctgtgatgtttactgatatggttaatggtcaatgtcactcatcaaaagggtgataagacaataatgggatcttggaacagggaagtcaagataagcacaatgtgtcattttttcccctacaagcatacagtccttaatgaagacaaataggccctaatgtttatttgttcaatgaacatgctattggattgtgaacaagaggtcagcgtgactagcaatgaggtgtaagctgctctatcaaagggtgatatttagtgactagagcaagtcctagaatgttttacagtaaaccattgtagttacaacacattgtttctacccctctgatctccaagagacaaggaaaataagtggatactcttgtctttccaatctggaaaatagaattggaagtggatgctttttttcatttctaattcatagctctttgatcttgattattcatgaagcatatgcgtccatgaccatgtgttaaatcagcacttatcatattttattgtgacattcattcctgggaattttattaaaatgcagattcttgggtgggagctgagattctgcatttctaaccagctgtcaagtattactcatactgtttctggtccatggaccatactttgagtagctgactgattccaacttgcaagacagagacagcagaacctgcctacatagatttagaaccttgtctcataatagtgcatgtatgcttagtgaggcagcatagtaacatggataaaagtgcaggctctgggtgtgaattctaccactacttttgctaagctttgtgtagtgccagtcacccctatagtctctgtgatcaatgacaacaaagatttattttgtgctcacattacgtgttggactgactgttggccacaagtgtgcaaattctgggaaccactttaaagacagccttctctgggacatgccattttaccctcatcttttgggaacctacaatgactaaaacttctgctcggatttgccgatgtcatgtccactcacatgctattggcctgagtcaggaacatggccaagcctgatgtcaatgaagcagggaagtagactccttctgcacacagcgtgtatagacatatggcctcctgcaggaaagggagtgaagagttgggacaagaacacacttttccattgtgacttagtagctatgtactcttgttattttcacaggattgttttgaggattgaataagctaaaatggatagtacattgtacctacatgacacttaggagaagctcaataaatgcctgtaattataattgcttttgtttttgttctcatacttcaccctagtcctcactgcacagttgctgtacccttgaggttgagaaaagtccctctccctgcctttcatgatacatgaaacatactgaggcccactaaataccaaacaatcagatcatctgaggcatctgcagttaaagaaaactggattactacacaatcagttatttccaaataattttagacaacgattgacttcttcctggccatcatattttctgagtttttgacttgagtttcagatcactagatttcccctgattattctctgaatttgttttatggcctgttcttgggtcgtttgttctacagatgtgtactgagcatccagtgaaagtcagctgttgtgtgaggagcaaagattcatataaagtgtggttactatttaatgaaagtttgtgagtacactcttcatagacgccctcattcactgttatctaattgccaggcagtgctggatgagggtgcaaaggtgaaatccagcctaaataaataggagtctggggagcttgagcatatttagttagccaaggggaatcactatagcttgtgaacagtccaggaatatgaccttggatttcgaaaaaaaaaaaattgtgggtagtatatgtaagttgttggagcctctgccattgggcacttggtggagtgagattatagggctgtgagccagagcatggtgtagtgaatgggatagatgtgtttgtgtgagaggaaaatatccagtggctgcatagctctgaagattatcagtccaggcaattgtggacaggcaataagtttatgtgatggaggaggtagtgcattcaactggggccgagagtttgcgttgtgaatagtataacaagacacagatgttggaaaaaggggttcaaataatttgcagaccagctatccaggtcaactagctgatgatccatgacacagtgcatgttaaaggcctatcaatcttattgtgtagaaggagtatagaccaagggatacgtagtcattaaatgctgaaggttgagatccttgttgatgcaattgttcactttactaagaggtactttttttttttcaatttgactaagaacaggcctgaagattatcagtccaggcaattttggacaggcaataagtttatgtgatggaggaggtaatgcattcaactggagccgagagattgtgttgtgaatagtataacaagacagagatattggaaaaaggggttcaaataatttgcagaccagctatccaggtcaactagttgatgatccatgacacagtgcatgttaaaggcctatcaatcttattgtgtagaaggagtatagaccaagggataagtagtcattaaatgctgaaggttgagatccttgttgatgcaatggttcactttactaagaggtacttttttttttttttttccaatttgactaagaacaggcgtgctttactcataacacacttgtttttggtgcagtatatcgcaaaacaaagttgctgtgttaagtttaactgtgatttaaactgatgttgcctgagtccccaaagaccaatgaaacacaagtgggatggaaaaagcagccacttctattgttgccaaatgatagaaaagatttgaaaaatcaaatgcatcaggttagcctcactgtgcagcaaggaaaaaaatgaattaattataaataagatgaataaataatttaaatatatcacttattgcttctttattgcttaacacttgaaaaattgtttcaattagaaacttaaactcaatttgatagacgaagagtgtgcagctcaagataaatgtaaatccctttgcgatataaaaatttgattttgcagtatgagctctattaaaaagaaattaataatctctagaaaaagaaggcagtgccaaggaaggttggccttttcccacagaacattgctttttaagaggaaaaatcagtaagcttattatagagaaaattttttaaaaaatcagaaacgcaaaatactaaccaccaaccccacaaacaacaaaactaataagcatttgtctctctggatttcatattaaaaccgtagagtaggtttttgtgcttcttatatttcacatgattttttgtctaagccagacaaaatgcttcattctctctttgagtttgttgggcctataaaaaatggtagaacagtccaggcatcgtggctcatgcctgtaatcccagcactttgggaggccgaggcaggtgaatcacctgaggtcaggagattgagaccagcggggtcaacatggtggaaccccgtctctactaaaaatacgaaaattagccagccatggtggcgtgcgtctgtagtcccagctacccgggaggctgaggcagaagaatcattggaacccaagaggcagaggcttcagtgagccgagatcacaccactgcactctagcctggggacagagtgagaccccgtctcaaaaaataataataataaaataaaacaccagaacaatttcatattttttgtacctaaaaagcaagggatttatgtatctgaagtcacaatggaccttacccaagacaagagtatcctggaaagttgctttgattcctgtgccatcatgttctaatgctgcaaaccctctctccgcattcttggcagatatggccaattaatgagatcatgatcttttgtatgtccagtctaaacctcagaatccctcccatcacaggcctccagccagccacttcttggcacgtggtatgaaacctactgcccatctgtcccagcagctgaaggactaagagttcaataacattttatctggcacatgaacaatttgcctgatttcttaactacgtgcaaacatctatcaccttatgttttagttcagtctgcagaaatgagttctttctattatgtatagaaaaaaagcaaatgtctcaggaaattatgtggcctatgtattttaccttttggacctaaatatacatctaagaactaaatatggcctgagaatcagctcccctcctccccagaatctcataacaaactgaacactcatcatccatcaaaaagcaaacacaaaataagaaaacaccagctgggccacaaatgccagtccaggcagctttcaattaacattcagagctgtcagaaactctacagcaggggtagaaaacggatggtctcagcccacagatgtcttgcttggccagaaggagttttatttctttattctggccctatgtgggtcccctcctctccaggtatcataggcttccatactgccccattctctttatcccagtgacatctgaagacccctgactttgtgattcctgatggcagaattctgtctttcctcattctcagtcacatatccgtttatctctcttttatggactgaatcatgttcctccagaattcatatgctgaagctgtaaactcctaatgtcactgtatttggagataggatctttaaagaggtgtctaagttaaaatggggatattggggtggcccctaattccatgtaagactggtatttaagaagaggagatggccgggcacggtggctcatgcctgtaattccgaggcaggtggatcacctgaggttaggagttcaagatcagcctggccaacatggtgaaaccccatctctactaaaaatacaaaaaattagccaggcgtggtggcgcatgcctatagtcccacgtactcaggaggctgaggcaggagaattgcttgaacccaggaagttgaggttgcagtgagccaagatggcgccactgcactccagcccgggcaacagtgagactctgtctcaaaaaaaaaaaaaaaaaaaaagaagaagaagaagagattaggacaccgggacacaaagagggatggccatgtgaagacgtgcggaggaagacgaccatatataaacctcaggaaaaaacctacctccaaacaccatgatctctaacttctagcctccagaactgtgagaagcaaatttctgttgctaagatccagagtctgtggtctttcactatggcagcccagaccaactaagacaccatctctagtcctgaaatcgtgaggaagcagcactccccaagtcaatctacattcagtgagctgtggggaaatggactgcagtgctgagcttcacggcctgagtccctaaggttgggatgaagacaatgtgaggagagtcactttgatttatagctccaacaattatgaagcctcttaggaatagggcaagaaagcattttactgtgtctcgactccaagaactataatgacatcttttaaaatttcattattctttttgtttttttgagacggtgtctctctctgtcgcccaggctggagtgcagtggcgcaatctcggctcactgcaagctccacctcctgggttcacgccattcccgcctcagcctcccgagtagctgggactacaggcgcccgccagcacgcccggctaatttttttgtatttttagtacagacggggtttcaccgtgttagccaggatggtctcgatctcctgacctcgtgatccgcccgcctcagcctcccaaagtgctgggattacaggcgtgaaccactgcgcctggccttaaaatttcattattctatttacaatataaatagcaatactaagccaacgtaagcggatattgtcagtgttgcacgctttattagagcttcttggaagatagacataaacacaacctgccatccagccgtgtccacgtgatggcttggagaggcttttgcttcagcagccagtcagtactaagcatatttctttttcttttctttttttttttttgagatgaagtctcgctttgttgcccagtctggagtacctctgcctcctgggttcaagcgattctcctgccttagcctcctgagtagctgagattacaggcaggtgccaccttgcccggctaattttttttatttttatttttagtagagatggggttttaccatgttggccagggtggtcttaaactcctgacctcaggtgaaccacccacctcagcttcccaaagtgctgggattacaggcatgagccactgcacctggccgattgaatgtatttttctatgaagaccttttccctgttttatgaagcatcaactgtgcattctgggtggaataacaaatctgagtggaatacttactatttacttgttatgtgcttcctagaacatgttacaaattcttatttattttttgtgctgtatgctatagcatcccaaacatctgtgatgctgtgttacactagagacaacattctcaggcttgcatgcacactcacatacacatgtgcacacacaccctcataacacacaattactccctccacaagtcaatcaaccaatcatttatacaacttcatcccatagagtgttctttaaatttcaagcccatgaaggatggtgaattctcaaagcaatttcattgcagagggcaaaacgagctgtcagaactagtataggttctattaagggtaagataaagtaaactctaatcagggccagtaagaaaaagctaactacgagaagcttgagaaagataaacgtttgcctggccaacacggcgaaaccccgtctctactaaaaatacaaaaattagctgggtgtgacggagcacacctgtaatcccagctactcgaggggctgaggtaggagaattgcttgaacccgggaggtggaggttgcagtgagccgagattgcgccactgcactccagcctgggagacagagcgagactccatctaaaaaaaaaaaaaaaaaaaagaaagaaagaaaaacgtttgcatcctagggggctatttaaccaaaaggtgtatggctcctgtgagctccagatagtggcttgtgaacctctgatattagaaaggataagaaatcatccgtttctgtactgagcctcaaagagaagactcagccctagttaggaaatacaaacaagacctatttccgctaaattggcaaagccaccaatcagagccatatagactttgtgtggtcaagcttcccaccactgatttcatgactcctaacggtagaattctgtcctgtgaggctgagaatgaacatctaactttaagaaatacagcagaggccgggcacggtggctcacgcctgtaatcccagcactttgggaggccgaggcaggcggatcacgaggtcaggagatcgagaccatcctggctaacacggtgaaaccccgtctctactaaaagtacaaaaaattagctgggcggggtggtgggcacctgtagtcccagctactggggaggctgaggcaggagaatggcgtgaacccgggaggcggagcttgcagtgagccaacatggtgccactgcactccagcctgggcaacagtgcaagactccatctcaaaaaaaaaaaaaaaaaaaatcaatctactccttgcatcatgtgtgacattttaattacctaggcagcttatcaggacataatgaagcagctgctatgattatagaattttgtcccaattatttacaaagctgctcagctacagaaatgtctcattgtcatatccagcatgcttaggttctagagcaggtgttaagcctgatttactggccaaatcagaaaattattccatggccgtcactttttctttggagccaaaagattaaaatttaagttattctctgaaagtgtgattttttttttttttaatcttgattgtcttcttccggctatcagctatctttcctcgtcgtcctgaaggtcttaatgtttccctggtttcattctctgtcttcttggtgttatcaaactctgctctatcggcacccttccaacaggtgagtatgcaatattctgattctcccaaaggataagatgaagcgtttgtagcaaaatgcttttcacagacccctagtaatacttttttccaagcataatgaataccgactatgcgccaggcaatgagataaaaatactcatatttttttctagtaggaattctaaaattagattctgattgctaagcagaaaacagttcttttaaggctacctctaaattgtggtgctatatggttgctgaaatccataaaacagtataaaaaggtcaactgttaaattaatctttgtgattgattattgctgtccttgcaataatctggtttaagttagaagttgcattgtggctttagttttaaatcgtcacagaatcccttccatatgcttttacagaaaagagagtatgatattttaaaagaagttcacatggaacattctctagggaggtagacatattgtgtgggcctaaatggatgaatttacaggatgctggaacttggagaaagtggtcaaaagtagctatcactgcaagttacctaacattactaccttgaggccggggaagttggagataagaatgagtgcttccaaataaaaagcagatggaagaaagggacctatatggataagagatgaatgagtttctactgaggaggccatgcttatgttcccattgtgactgggatggctgagatacagtacttcctctagtgaaggtataaaacaaaagttatttttctcattaaaaaaaagttacactttaacacaaaggggaaccaaatttacttacaaacaaaacaagtaaggatagacagggtcacacccccatggcctgaatttgcataatgttgtccttttagattaagaagaaatgtgtgctgatgaattgttcatttttattcagagcacagaaatctagtttcagaaaagaagtgtaggtctacttgagtcataatgttttcttattgaataacatgcattcatttcagaactaaatgcatttagtttattgggaataatgaagtaattcttggaagagggcgaggaaagtggacagcatgttttattctggtgttgatttgcttggatgttccacagacagtccaagctttttgtaggtcagagaaacatccttaacctggggcaaactttgacacccagcagatgccttcaatcctctttatctatcatagtgtctgtttttctgtggtctcttttactacttcaggtttgctattaatgattatttgaactcatttcctcagtatacaattgggggaggagtggagaagattaatgtcatagtgtcattttttccctgtattttgtgggtctgacctcgaattctgatccttatactctcttaagtttatacatggatagaatgttgtatcagaatgtacttataatggttgcctttactaagagtatattaattatgggttgagcttataattaattgacttcatgattgtaaaagtgaagggcctggtattacaccgaactgcttcttagcacaaagtaggaactcaatatatatgagtggaatggatgaataaaagtgagtataaataaaccatgactgctaagatgaaccactgttcaattgtaaacaatgcaagataacccaatcgttttgacattatgagggacgtgcatcttttcttgagaaatggggtgagacattaagtcaggggcctgatatgaggaagtggtagattcatttgtaccagctgtttagtgacaatgagaagagattacagaagtccagtgtgtctagactaggccacatgtgatttttatcttaaatctgatagtggcatgccagttaggacacatcattcggcaagatgtaattgatatctcaggtctgggaaaaaaccttaaattgttttgtgctcttctgagtggctagtatgcaagcccgcacatttaagattgacatcacttttgagggtgtttctgcccctgagtagggacctgccacatggtggcaaatgtgtttctgtgaaatactttcccagcctgtatttcatggactagtcctaggtggtctttgcaaaatagaaaaaagctgtgtccatgttcaatgattcaatgtatttagaaaattgccatacgtttcaaatcgagcccttgggctttggaatcaggcagggctgggttcccagttggcaagtttgcaaactgtgtcatcctgggaaagtaacttagcctctctgagtttcagattcgtaatatgaaaaataagaataataacaccaaattttggggactgactgatgattaaacaggattccatatccatatcatatttaagcaattttagtggtagcctatagtaactaaactataaatattagtgattacgaccattattatgattagtattggtttctttctcttgggtatttaaaatagacataaggaactctgacgaatcccaaggtgaagaagtcactgacttgccttaaccagcagtttctcactctatttgaccaaaggtctggctttttcacttagcatgaagatgccatgtcccctgcagcaccttttgagaaaacatctaagtgcactacttctcaaaattcagtgtcccttcaagtctcctgggtgtctcgttaaactgaagattctgattgattaggtccaggtgggctcaagactgtttctaaaaagctcccgtgtgctgctgatgctgctggttcgtggacctcattataggtagcaaggactgggagcccgtgactatggtacctgcatgtctgaagtttatatgtggatgatttctttctttctctttcttcctttcttcctttctttctccctctttctttcttccttccttccttcctttttttctttctttccttccttccttccttctttctttgttttgttttgagactgagtttcgctcttgttgcccaggctggagtacaatggcacgatctcagctcaccacaacctccgcctcccaggttcaagcaattctcctgcctcagcctcccaagtagctgggattacaggtgcccaccaccatgcctggctaattttgtatttttggtagagacagggtttctccatgttggtcaggctggcctggaactcctgacctcaggtgatctgcccacctcggcctcccaaagtgctgggattacaggcatgagccactgtgtccggccagatgatttcttttagatgagataattgcatatcagcattagggaaaaaataccatctcaatggaaaatgatgatgggagtatgtggaaaggaaagaaactagtagtctaccattttatgtgggtctgtctctacccttctggactgtaaattctctgaggaggcagatgtgttggtttcctcactgctctatcccaatgcccatggcttttcttggcatagcatagacagatacatacatattaaatgactgaatgaatgaataaatgaatgaatgaacgacaggacaccgagtcttttcatcctgggagtcccattacatgccacatcccagaggttggcgggaagccatactgtggtaactgaaagatatgtacaagattaggatttaggcagcatacgaaagccttacttttatgctttatttattgaaagtactctctattttttgttaaaagtctgtactgctattctcctgataagtgtattggccagtgaggccttcctgcccttattttaggaaacttcaggagcaccttttccatggtgggaccacaaaggcagttttccatcagagtaattccacagtgagctcaaggaagggtacaaggatggattgaataatttctcttacagctcctgaagctctctacaagggagtattttcttattagtgttatcacagctcctggaggataatagacaatcaactgaggaggtcctcaaatgagatttctcacagatttgctcatcagtgtggtgcaggttcatagctttaaatctcaccaaagatagtttatgtttgtggctcaatgcaaattgttttgcccacatctaaatttatttccattttatttgtattggtctctacttctaaaaagcttttagtgcagaatcatcgagttgacttggaagttatctttctgtgcatttagactttatgaattagaagactaaatggtatattttaaatggatataaaaaatcaaatgaataaaataggccataattcagctttgtttagaatgaatattgtctcagttcacttgggctactataacagaatgtcacacctgtgtgcttctcaaaaaccaacattctccccccacagtactggaggctgaaagtctaacattaaagcagcagaaggttcggcatctggttagggcctgcttcctggttcgtagatggtcatctcctccctgtattttctcacagtggaaaggaaacaagagcactctctggagtcaattctatcagggtactaatcccattcctgagggcttccatgaattaatcacctcccaaaggctccatctctgaataacatcacattgggggttaggatatcaacaatgaactttggggaggcacagatattcggcccattgcaaatatatttgtgcaaaggagattctaataaatgttgacttgtttctgtatgttaatccaaagcacgttgtattagtccgttttcacactgctgataaagacatacctgagactgggtagtttataagaaaaaagaggtttaatagactcatagttccatgtggctggggaggcctcacaatcatggtggaaggtgaaaggcacgccttacacggcagcagacaagaaagaatcagagcctagcgaaaggggtaaccccttataaaaccatgagatcttgtaagacttattcaccaccatgagaacagtataggggaaaccgcccccatgattcaattacctcccactgggtttctcccataacacatggggattattacaattcaaggtgagatttgggtggggacacagagcagaaccatatcacatgtttttgtatattctctaataaaatgaataataaatagttataaatatataaaaatatttatatatttttgtatatatttataaataaaataataaaagatgagttattttataaatttgttttaaaagaaaattttcttttaaaatattttcttttctccaaaaatattgcatacctattagattatatacagaagcaaatttgacctttccaattttttaaaggtctgtatgtgaagaaagagaagaatgcgattttttaggctactttgagctatgctccccagagttctttaggaagcaatggattcttcaaattgggcatccttaaagcatcacagtcatttgccttcaacaatgcagtgctcatggacatatgaaagacattttaatgcagttttacatgtgacaagttgaaagcgtcttccaagagttccaccacactggtgctgtccactccattgctcgggattctttgcagtgatttttgagaggtgtgggccttttcctctttatgtgtcacgtgactccacagatgcctttcctgtgtcacccgcagcagatattactttcccaattaaagtccttttaaagaatggcttttctccaaaagtggaactgaggccttttagtggtttcttgctatttttgacacacatacatgtatgcatgcacacacacacacgcacacacacgtacacacacatgcagatagtagcaggtttaaagctacacattccacatcaatttctccccatccctggcttccaagtgcacggtttggtattgctgtctgtgttacacaggttattgctgcaatcccatgtgccggtgctggtcaacactgaagagctgtgcccgcacctcatctattgtaaatcagtgccagccttagggtaaattaccttcctggagtgagaactgtaacctgctaatgctgctatgtaacagtctcagcaatgtctgactccttcttcggaatgttgttattgaattaggtgttatccaatgtccacttttacactctcccttctctcttttctgtaaagaatttggttgcattgtttgtctcaaggatgaagaaaaataccaataaataccaccagcaacctcccctggcaggttcaggacataagctccataatctgaatttccctcctatgtttcatgaaggtagatgatgtaatccctatgtgatccgcctcagggcagtcatgttaaagtgtgacccacctgaattctcaactaaaatttaccatacaaaaataagtggaaggtcacttgcattacggagaagcaattcttaatatgacacttatttatttaataagtacagactgaatcccagctatgtacaaagcagaaagtgatttttttttatttattttatatttatttattttttagacagggtctcactctatggaccaggctggagtgcagtggtgtgatcatgcctccctgcaacctcaacctcctgtactcaaatgatccttccacttcagcttcccgagtagctgagtctacaggtgcatgccaccatgccctggctaattttttgcattctttgtagagatgggacttcaccgcattgcccagactagtctcaaacttctgggctcaagcgatcctcccgcctcggcctcccaacatgctgggatttcaggcttgagccactgcgcccaaccaggaggtaattttaaaactcacaagccacacttcctttctgtgagaagtttgtaatttaggatgaaaactaagatgcttaggctaataattaaaatgaaagcccattaccgattcaaagtaaaatagaagttaagaaaggcagaggccacttatggtcagttggttaggaaatagttgctggacgtgataccattggagttgggcttggagagtggggcttaatttctggcaggactagaagagaaggtttttttttttgttgttttttgtttttgagatggagtctcgctctgtcgcccaggctggagtgcagtggcgtgatctcggctcactgcaagctccgcctcccgggttcacgccattctcctgcctcagcctcccgagtagttggtactgcaggcgcccgccattgcgcctggctaattttttttttcttttttttttttttttttgtatttttagtagagatggggtttcatcgtgttagccaggatggtctcgatctcttgacctcgtgatccgcccacctcggcctcccaaagtgctgggattacaggcgtgagccaccgcgcccagccaagagaaggtatttaaagtagaggaaaatgggaagaagatgcagtagcttgaccatttaatgatgaaacctagtgcagtttggctacagaatgtaagtaggacatagctgaggtctgttgagaagcaataatggcctgggttggggtggtttctatggaaatgcaaagaaaagttaattagctcacagcgtgagcttagtacattcatctctctgtatgtgtgggggattggtttcgggacccccaagtataccaaaatccaggcatactcaagttcagaagtcagccctatataacctgcatataaaaaaaggttgtatacttcagttttccatccctcaaatactgcattatcaagctacgtgtggttgaaaacaaatctgtgtctaagtggacttgtgtacttgaaatccgcattgttcagagagtcaattgtatgtacattggaagagtgattgcagtaatgaatgctatttactaatctgatgttctgccgttctatatgctggaaagtaaacacatgataaaatttaaaatgtacaaaatgggccaggcacggtggctcatgcttgtaatcccagcacttggggaggccaaggtgggcagatcacttgaggccaggagtttgagaccagcctggccaacatggtgaaaccccatctctactatttttagtagagatgttaaaaaattacccgggcatggtggcacgctcctgtaatcccagctactctggaggctgaggtgggagaattgcttgaaccccggaggtggaggttacagtgagccaagattgtgccactgcactccagcctgggtgacagggtgggactccgtctcaagaaaaaaaaaaatgttactattaataattcaagagatacatgttaaacatcttgttttgattttgtggaatttaactacatcaatcgcctgaaatatggccacagaaatattctagtattataccatatttagtgtacataaacaattcaagtactagtctgctagggtcccataacaaagtacttcagactagtggcttcaacaacagaaatttattttctcacaaacctggaagctggatttctgagaccaaggtgtcagcgaagctggactctcctgaggccattctctgtgtgtctttataggcccacccctctacatgttcctgcatcctcatctcttctttttgtaaggacaccagtcagattggaacaggacccacccatatgacttcgttttaccttaaatacccctttaaagaccctatctccaaacacagtcacattctgagcaactggggattagaaattcaacacatgaattttgtggggacacatttcagccggtaacactccacacacttgacttttcaagtttcttataatatttttagttcataaataggataacaggagatatatatatatatatatatatatacacacacacacacacacacacacacgtttatatttggaaataggtgaggcacaaaattataaatggtaagtaaaatactgaaacccaagtcacctttacaaagtttaggtggccaagaggttgcatgtcagtttctagagcctcatcatgccagtatgcaggtgggtggtcccttagcttctgatagaaagaacatgggctctggaactttgtttggaaagaacacgtgcttcagcacaacttgcatttaaggccagattctgctatttacaagcagtgtgacttgtctggctctgcttccttgacattcaaatggagacgatgacatctacatctgcgattgttataattgagaagatgcatgtagaaagccctaggctcctaactctgcttgtaaaggtgagattcctacatggtgtgaatgaggacacacttctgaatttgatctgtacatcaggtgtctgttttttccttcccatggatatagctgtatatataaatcttagttgtcttttttaaagaaaacccaagctccttaccatctggtctctgcacaccttccttaccccacccagccctctgctcactatgcagtggccacatgggcatttttctattccttggtgatacccaggtaattccacttcaggctctttacactgccatccctttgccaggcccggctgtccctccaggtcactcaagtcctggctaagggtccttcacttactatgtattctgaagtcacctcccatcaactcacctattttattttcctcttaactttttatcatataaaattatttattgatttgctttttataccatttgtcttcctcacctttccccactggaatggcagatccatgaggacagcagcttcgcctctcttattccctattgtaaactggaatagtgcctgaatttgatacgcatgcaatgagtacttttacaagaaaatgttataaatgtgtaacagcattgaagggtataaacttccttcagataaatttggcaatacatattaaaaattaatactgacgtctgaaccaaaatttctcttcgtcagaatccattccatgaaatgattgaggaagtttttaaaaagtttaagtgtgtttatcatcagtcagtcaggctatggtaataacatcctaatagcccgtcttgcctctctctactctccttctttcatacttcagcccaaaatacctttcattcccatttttaaaaatacaccaaaatgatcaaggttaaaaagtcaaaagtctaatatagtagaaaacaatagttagctattccatcttttctgagcccttccatgggcaggattattcaaacacaagtttagtctactcacactctttttttttttttttttttttttttttctgtttttgagatggagtttcgctcttgttgcccaggctggagtgcaatggcacgatgtcagctcaccgcaacctctgcctcccgaattcaagtgattctcctgcctcagcctaccgagtagctgggattacaggcatgcaccatcatgcctggataattttgcatttttagtagagatgggttttctccattttggtcaggttggtctcaaacccccgacctcagatgatccaccctccttggcctcccaaagtgctgggattacaggcatgagccaccatgcccggcccacattctttatgatttttgatatactgaacttcttttcacaccttacttttgacttctatttgtcacactttatcatccttatacatccttctttctttgtttaataagtttttcttttttacttttactgtacttacttagaatgtatatattctatttccatttatttagatgttaccttggaaatttaccatgtacatttaaattagcaaaagtctgcaattaagcaataacctaagcaccttcttccatgaaaagcaaacaaaaaacaaaagcaggttttggagcattttgattctgaacactcacctcaaaacctacatgcttctgggccaggcacggtggctgggtgacagagcaggactccgtctcaaaaacaaagaaacaatcaaacaaaacttacatgctcctgttgttttctctacttctatatatttatttttttttaacccagatactaggtattattttattattagcttattcagatgttatttctttggatttgcttactgttttataatttcatttgttcattcttacttggatcccaaaccatctttttaaggtcgtgttcctttttcttgaagcatatcctttagaattttctttatttcaggtttctttgtggcataccctctcagtttttgttatctttacccatccttgttttatctttttcataaaagagtatttggctgggcacacaattctgtactgactatatattttccctttgtactttggaggtaaaatatcattatcttctagctttcattagtgctgttggaaagtctgaagtcatttaaattgtttcctttttgtaggctgtttgtccttgctctatggcttcatttaagatctcctctttgtttttgatgttctgtaattttgtcaaagtgtgtttggacacaaatttctttttatatattctgattttatttatctcagtatattgtacttttgggatttttaatacatattttctgatagttctaaaaattgtatctttttaatgattttcttttatattcctgagattccagttagttatctatttagtcttctcattctgtattttatttatcttagtgtctctttcacattcttcatcacaattctatttttgtcttacaaatagattatctcctggaattcttaatgatgatgatgatgattattttcgttttctcccgttttctgaattgtgtttcatccaacgtttgtatttttatatttgttgccttggtcttcctccttcatgatgcaagcattccttgaatatctgatggctgttgatttccatttatattaaagattgagcagataggaaggaaacttatataagtgggcaagggttatggaatagtctttgttgctttatgatgtgctgttgtctgaaggttttcggctcccaccaaatttatatgttgtaacctaatccccaatgtgatggtagtaaaaggtgcagtctttgagaggtgattaggtcataagtgtggagctctcatcagtggaattcgagcccttataaaagaagcccaagggagctcattggccccttccatcatctagggacacagcatgaaggcgccaactatgagcaatgaaccctcaccagacactgaacctgccagtgccttgatcttagacttcttggcctccagaactgtgagaaatacatgttgtttataagtcatccagtctatggtatttttgtgaaagcagtccagcagactaagatatagtgagagagatcggtgcttcagaatctgctgacatcttttggttgctgacagcttttcctgttttctttgccataatgattttccctcttttcttagctcattactcttattttaaggaagcttaaagggaatatcaatagctcattctaccatcttgaattaaaagccacatgtaattttttaagaagaacactctcattatattaatctcttgcttgaaatatgctccttgctgcccattgctcatagaacaaagaccaggatccttacgttggtccccaaggccctgaacagccttctccccagagaatttccaccttcaccttaaatcatgctccatctggctttctgtgctcttttctcttctgctagtccacaatgactcctcctgtctaagggatgtgcacacatcatatgctctctgtctgcagggcctttctccttcctctggccctcacaacccctgctccacaactgcaacctcctaatagatcaatttaccctcttgtattatctcagagcatcagagatcttctttgtagtacttatcaaagttgtgatttttctttcatttctatgactatttgattaaatctgtctcatccgcaaatagaagtgggcagctgatcataatcctgaaagacacagtacctagaacaccataatcttgaatgttgaaatcctagaaagtcaaaatttgcaaagtctaaaatcctgaaaataacaacactgaaagatcaaatccccaaattataattctggaagaaataatataaaaaattatattagaggtatttatttatatttttaaagggggatttattggaaaaacataaaaacatcatcgagaaacatgataggccactttacacaataaaataagcaataataacataaatatttttgcaagcataaacactcaggtatactaatgatagtcacatgagcataacagttaggaacagacagcacatattcataaagaaacaggctaaaaagggaaatgtataaattcacatcactatggttggttattgtgtgcacccagctttctaactacagtcgtctgaaataccatgatgaacaaccttagtcttttgacgagtcaatcaaaactgcaaaggttcgccaccgcatttgcaatcgcccaaagaaccaagatctccagaaattgcatctttcacagatacaaatgtacaaaaaggacatctcttcatttattgaggaagttccaatgtttatactttgagaaccagggatgccgacgatgtgtctctcagtccaaggttgaaaacctcaggatcctgggagctgctggtgtaagttcctagagtccaaaggttggcgaacctagagttctgatgtccaaggcagcagaagaaacatctgtcccagctctcagagagagggatctgtgcctcagaatccgttgtaagcttttgttgctgacagctttttccaatttgccttctgtatttgttctttcctggtgcccagcgaattggatggtgcacctgacaacatggaaggcaaatcttcctcacttagtccacccagattcatacggtaacctcttctggaaataccctcacagacacactcaaaataatactttaccaggtttctaggtattccttcagttcttaatcaagttaacacctaacattaagtccactggtgaccacattaagtcactactggtcaacgtgggtaacttggcacccatattcctcgccttaaaccatgcttaataacaagatggctagatctgcctaacatgatgcaactattttctgatagtgattttcaagattttagatattagggattttaggctttagggatttgaactttgagatttttggtctttagggatttcaatctttcaggatttcaatttttgggatcatggcatttgtgattgtgtcttttgggattatgatacaaacccaacaaggggtcagattgggtttgaaaatgagcaaaattattttgtaaaaattataattatatgttatataattattacataataattttgctcattttcattccttagtctccatgtagtgaatgaatgcataactgaatgagagatgaataatagcagtaaaggaccttggatggtttatcttatgctattttttgaggatattcaggagatctttgttgaatctgttccatgatcatggtaagatgtttaagctgaatctcagactcaccgagatagaagtaagtgatgatgaagtaagtgatagaactaagtgatgatgaatgtggcttccagtatgaacatgacttatttatgtctaataatgtgttccatttgtacagaactttaggctttttaatatagtttcacatattcagattaattttatcttcatatttttatgagacattttgttggttcatttagatgaactggaataagactgactcatgtctctgcaggttatgagacacatttagaaacgaagatgctaggatcatcaaccacatggccaggcaacaaagaaggaaaggaactgtcactcatgtgtacctttccgaaagtggagcctggaaggctgtttgagctcccaggcagtctggagcccatgctgttccattgctccttcatgtacaacccacggagcttcacctgaccattaacttcactcagtttgattcccagcacaccagcctctgtctatgtctctctcacatcactttccactatgaattatgcttgttcttcccctctatcacttctatgctctttcactctacatcttttattaaaatctcagagagagagaaaaaagattggtcttagggcagaactctcatagtaactaagtcacaggccgcctgtcctgtatgatgtggtgtgcaaagcactgttgtcttaaagtgctctggaagctcccttctggttgttggacagcatctcagctagcacttccccttgttcccagtggggaagcctcaacccaatttcagcttcccatgggaccaatatcttcctttttcagggtaggggggatgcatctgaacccagcttctactgtgtcttcaaggcttccgtattctggggatctggactttccaaacagttgcttcaaacagctgacatctaaattcatcctgcctggtgccccggtagctggattattcccttacttacaagattgctctcacacttgccttgtttaaagggcaggcagcctagcagaggggaacttcccctagaattcacagccacactgcctgcccaccacagtgtcttggcccaaatgcctttctatggcatcagagggaaaatcaggggcctgtgctttcttttgcttacttaccttggcttgtaggcactttgctgaaatgtgttaggttggtgtagtgggttgaacagtgtttcccaaacattcgtgttctcctggtacctcagaatctgaccttattttgaaatagagtatttgcagatgtaattaagttaggatctggagatgagatcagcctggacttactataagccctaaatccaaggactggtgtccttctaagagagaggagatggaaatttagacatgaagacacagggagaagaaggccatgtgaagacggaggtagaaattggagttgtgtgtctacaagccaaagtatgccaaagattgctggcagataccagaagctaagagaggcatgggaattaacactgcctacatctcaattttggaccaaatttctattgtttaaagcaaccagacatgtggaagtttgttatggcagccctcagaaatgtaaacagctgggtttcctagaagtagaacctgagaagggggttctcgtgcgagggactgatgaaggattggttgaacaagggttaggtggggagctgcgtaagtcagggatgtggtttcagctggggactggcctctgtctgacctcacaggctggctctggcgcacagagcgccctgcagggatatgatccacctgtggcaatagggccaatgctttgacccctaggtcagccagttactgactgtgggctgctgggagtgagcaatgcctccagcaggagctgctttttatttgacagaagacagctctccgggacagggtccaccaccgcggcgattatggcaatcgttatttcttaaggcaaatcctgtgaagttatggaatttgttacgggccctggtccataatggtggcagccacgagaggacgtgatttgcgtgagtaacacccacaaagggaaccacgttgcacagcacagcagatgcccaccattccggcagttatctgtatttgggaagggggaggttgtatgatacagagaggaagagggaatttggctggggaggccaccaaaccaagacaggcagttggacatgggcagggctcctgctgagggaactaagacagttcctaaaactgcctgagctctatgcagagccacccgcagcaggaggtataggacacaggtctgacatgcctataactgagaggaaagagataggcaataaccattaaatcaggctgggcacagtggcttatgcctataatcccagcactttgggaggccaagatgagtggatcacctgaggtcgggagttcgagaccagcctggccaacatggtgaaaccccgtctctattaaaagtgcaaaaattagccaggcacggtgacgggtgcctgtaatcccagctactcaggaagctgaggcaggaaaatcgcttgcacccaggaggtggaggtagcaatgaaccaagatcacaccattgcactccagcctgggggaaaagagcaaatctccatctcaaaaagaaaaaaacagaaacaaatcactttttaaacctattactagcaaaacatttaaaaacagaagctagaagtatgtgttgacacaatagcacattttatcagcccttattatgaaaattctgtgtcaattcccgtccacctgactttgaagttatcagcatgtgtagcaaaagtgaatatgtttcatggcctctttcccatgaacgtattcacattttatgaaataataaaattcgcataaagattacatcataaactccagtctccattttcccctcttcattgtatgcgacatacgcacgttccctgaaaataaaatgtgcgtgtaaaattaactggctattttaggttgagttcccagtgtacctatttggaatgcctttccaagtcaaaacaggttttgaggctgtaacaatagcatcacaaataaaacaagttggattcagagttttacctaaagtaattgggagtaaaaaaggaattgttcaaggttccccactatatcttcatacttcctttcgctggctcttgatttacttagagatgcagttaagatggaaatgagccatgcccagagggatggagaaggcagagtgagtgagttccggtgttgcttttatgaaccacgcaagtgctctttgcagaaacctggtccggaagccttcccccgtgtaggtgcggagaggagaaattgctcacagtctgaaggaatagcatgcacaagaacacattttcaaggggttctgctttcaaaactccacctttcgggaaaaatgtaaaaggtgctttgagatgaccttcactcttgtttattcccaatactccctcctccatccgtttcaatcattgcagctcagaactgcgttatgacagcagcctgaagaggaacccaggcctgccttataggacacccagcccatggcctgctcaatgaaaatacctggtaaaatgggcagcatggttctatgctaatgaaagctcgtgcccttaagtggctttctgtccctcatgtgggctgggtggcctgtctcccactgcgtgaagcctacagctctttacactgcccaactctgtttcttggtttagtttgactctgcagctacccttgggcatgccctggagtccggcagcctgggggtgctatgccatgtccaggctgcctcgtgtttaccatgatccccttggctgctttctttctttcattctaaatctcctggaagtttccagaagaaaagactgccaacttctcaccttggcaccctttctacctcttctgtttttgcattttacttttactttcaatatgcctctgcatctgtttagtaacaactaaaaagttttcctagctaggttatgactatctcaggctttgaagctctgttcttcttaccagccacatggttagggctgcctaactaacctttctgtgcctcagtttttttcatctggaagatggggatcccataataacattcgcctcctgtagggttgttgtgacaattaagtgagttttcacacaaataaggtttagagctgcacctggccatttgcaggtgctgagtgttagctgtagtttctttttctacacccccaactgttctgaaagacggtaagggctgtgagccctgacttggccgttatcagcaattttgacaatattgcattctttttccatggaaaaaactcgaataactcttacagatgagtttcaaagtcaatacaagatcatcactgtattctacagttccagacttgggtgcagtattggtgcctaagctggccaatttcctagccattggaggtgtgagtctcacggcactactttaatactttgatgctgagatgccaatagagaaagaaaatattgaaaagttgagaaactgattctgaatttggtttttatattttgataaaaatgaagagaaactaaaagaatttaaggagaccagtcttttaagaaatgttcaagtctactttttgttttgtctagggaagaaatgaagaccagttatacagcaactcccttttgtttttaggaagataattggatataattttgagaatgttccttggtttaacctcggggaagagttcagtgttattgttaaagaaaaaaaaatgacctttgataaggcagtaaggcagactttattcagagccatagagaccctgcaattgcattttgaagtgggcgagagagattgggcacaattccaaatacaaaaaacaaatgggagtttatagccaggtagtgaggtggggatcagtggatggaatattatttacaggagacatcaagggtaaggggcattctggctacatcacctgaacatgactcttgctgaacacagaccagggtgatcagacaaccacctgggggttggtgaaggagaaacctgatcagatagttagggtgatcagatacccaggatagccaaactaagcaggattcttgctaaaactggagaaggcagagacaagaaaaaatgctccaaagtcagggcttagttgagaagagcttagagaggggcctgcctaaagtctggtcagggaaagagtctgtcgtgatacacagttaagcacaagactcttggcagatgctatgagatccacctctccagggatggttgaaggaggctggcttggatttgggactctctgaaagggctctcactgtgaagacagcaggatgctgacaatacccacctgtgtccaccacagcatgcaggcctcatctacttctccacccacctgtgtctgccacagcatgcaggcctcatctccttctccccatgggtgcagcacagctggccagctttgaggttggggtcatctgtgggtctctgaccagagctcccacattccctaaatggaaaatgaaacctgagaattttctgtgctgcaccatctttgctagaatacttggctcaggaccaactatcaagaatatgagagaacaagtagtgtatcacagagatgtaagtgtcaatccttgttctggaatgttccctgcagtggggattcagcacagatcatggccacttatagccttgggaagtgagagcagagggttggggaagggcccccatgagcctttcaggtctagactctagtggattaataggagcagacatccccagctgccctctagagatagttctaatattttagtcaccatactacttcaccctgacatcaaaggacgtcttcaatatgcatctctttgataatctcccctcttgggtgaatttcagcctgtctcaattgggcctccaccttccttttcaaagaaaatgccttgttttttcctcttgttctataagatcttccatacccctatgctatatccgaggtctggtgctcaacttctgttctcagtaactactggcttttgtttctaactttcactacaattacaatcaacgcaagctttgggaagcctgcttttaccttgaagcacttccacatcaggaggtctgagtgcagaggtgctccttacaacagatggattgctgcacttaccggggaaaggccatcctgtgatgttcaccaaaactaacaaacacctggaaatgggaattgtgtttaatgaaaataaactgaagctggcttcgttcattatacccaaaatattagccatctctaatcttttcctcacaggttatgccctgcaggaattactgggagggatagagaagaatgctttcggttagtgaaagacaagctgtaattgttgggagcactggatgagaaaatgcacataaaatcacttggaaacttggattagcatgcaggacagataggttctgaagctcttcccagaattatcacactgcagcccctcagggtgggggtggggggaggggtgtcaccgtaaggtaatgaggcaggtgggaaggccacctgtcttggctcagagccactggggtgccatctgggtgcaattcaggcagggggtgactggccacctgtcctggctcagagccactggggtgcaatctgggtgcagttcaggcaggggtgaccatgttttctttaatgaagttatagcctatgctatgtgaaatacctggatgattccctaaaatcgactttaacagtgtttgcctatattagtcaactttagagtgttttataagtagttttccacttaatcacattcattattcttgattttttttctttttgtccctgtcactgaacatttgcatatgtagacaaaataaaatgctgtatatctcatagtgaaaccatgtaacatgcacacacgcacacacacacagggagagagagaaagagagaaaatggtgagccatgtatcaatgatcataactgactaaactggcaatgttaaactactgcgggttctacctctcaaagatcctgaatgtcacaggtggcaccatccgtagaaatggtaattcatcccgtcaattagctgtgatgctcaggaccaaatgttagcaaggctgggattaatagcaagtgatcatttgcatctggcattcaattgggagctgccatgagatgctcccaccctggggtctctgttctaaatatacgacaggctgatactttgcaggaaggttcattctcaaacataaatagcacacatggtctttgcattttgcctcccatcctagctggagaagcttattttgtatgtcatcctaaaggtcaactttctcacgctaaaaaagaaaatgggcatcaggcgaaggtgcagggagcgcagagaatgctcagtgcagcagctggtggttgtcctgtacctgcttcgtgcttgtctgtgtgttttgcccaaagtgatgtgggcccgaagttactgccaggatctgtctgtgccctagttttgcccaattctcacgtcaccaattctacgacccttatttcagattgaaattttttcatgtgagacccactacctgaagaaggcaaccctgcttacttactctagtaggaaaaggaatgctggttttctcagagtgaaactatttaaaatcttaccccttatttttccaaacacacccctcccacagtgctcctaacatgttttagttgacaattaaacgtctttgtgaattagtttttttgttccctgttccacatttcccctacccataaggcttacgtatttcctgtaaagcaagtacccttcttttaaaacaaagaaccatgaaattaagaaaggttttttggctggacacggtggctcatgcctgtaatcccaccactttgggaggccaaggcgggtggatcacctgaggtcaggagttcgagatcagcctggccaacatggtgaaaccccgtctttactaaaaatataaaaattaggcatggtggcatgcacctgtaattccagctacttgggaagctgaggcaggagaatcacttgaacctgggaggcggaggttgcagtgagctgagattgcaccactgcactccagactgaacaacagaaagagaccctgcctcaaaaaaaaaaaaaaagttgtttttttttttttttttttggaattgttgttttgtctttttaaaaacattagtgatggtgaccaaaacttggaacttggaagctgtcagttgggtgaggctttccaggctgtgttttctccatctgatgctcttctagcaagcattttctttcagtaaaactcccaggggaaaagaatgtgaaataactactttgtaaatgataccaagcctcaatgttaatgttcagtattgatattgaatgtctctcagcattttagttagttatgtgtcatcttcccttaggtttaagaatgtcatatatcagctatcctgttaaggatatgtatttaatcctttgaaaatatatatatatatacacacataccaaatacatataaaattgaaaggctctgttttatatttttatgtatggggaaaatggggagaatttcaacttactttgtaatcgggtcctaacagttcatgatttttaataagtagcaatcttaccagcagtgctttcccaccgtagatttaattagtctttcttcccccacccccaaccccttttgctagttgacggagctgagaggagggaaacggccgcaatttgaaaccttgttagaaatttatgaagtgctaaaatgttttattcccagaggctggcttgccagctgtcacgagctccctgcctgcctccgcggctgtgatagcaggggtaagagggaggctgccagagctgcacagggtggggaaatgccattcccatcagcagcacagggcggaggtcagctcctcgttctcctgcagctgaccagccacatgtgagatgagaattcaggggatctggagcgggcatcggagccctagagtaagaccctttgcggctgttgataacaggcactgatcgctgatcatgcaatgagacgtcagctttggttatagaaattaaacaaccattctgttggtggcctcaaacagataattggcctcttactagcaaaatgtccctgaactaattttttctggaggaaacaccttctcacaaatgttaccaggtgtgaaggatgttcttcccggggtcatagcctacctgcaatgactctctgtgtccccatccctcccccattgcttctatgatgcctggaatgtgtctctcaggaaacaaagtttaaaaaaattttttttctttggtccttgaatggaaatatcacttgcacactgtggtcatagataccccagagaataaacaattcataataaaggtgcaaatcacccacgttagatgctgagctggaggaagtgctaagtctgacatgatggagaccaaaaggccccacggaagcagaggaggaggaggaagtgcctcctccagggccaggggctgggccaggcagtgccttcatgatttgcctccaagttgctctgcgcaaggaattgggcatggaagaaggagccagagacctcagaaatcttcatggcaatgacattggttaggaaagtatgccctcagcaccctctcctacttcctctgcctctccaaaccaacaattatagtaagtacttttggttccacagaactttctgacaagttctttttttttttttctgtgatacatgtgcagaatgtgcaggtttgttacataggtacacatgtgccatggtggtttgctgcacctatcaacccatctcggttttaagccctgcatgcattgggcatttttcctaatgctctccctctccttgccctccaccccctgacaggccccggtgtgtgatgttcccctctctgtgcccctgtgttctcattgttcaactcccacttgtgagtgagaacatgtggtgtttggttttctgttcctgtgttagtttgctgaggatgatggtttccagcttcatccatgaccttgcaaaggacatgaactcattcatttttatggctgcatagtattccatggtgtatatgtgccatattttctttatccagtctatcattgatgggtatttgggttggttccaagtctttgctattgtaaataatgcagcaataaacatacatgtgcatgtgtctttatagtagaatgatttctaatcctttgggtatatacccagtaatgggattgctgggtcaaatggtgtttctggttctagatccttgaggaatcgccacactgtcttccataatggttgaactaatttacactcccaccaacagtgtgaaagtgttcctatttctctgcatcctcaccagcgtctgttgtttccagacttcttaatgatcaccattctaactggcttgagatggtatctcattgtgattttgatttgcatttctctaatgaccagtgatgatgagctttttttcatttttttttttttttggcggcataaatatcttcttttgagaagtgtctgctaatatacttgacccactttttgatggagttgtttgtttttttcttgtaaatttgtttaagttccctgtagatcctggatattagccctttgtcggatgggtagattgcaaaaaatttctcccattctgtaggttgcctgttcactctgataatagtttcttttgctgagctgaagctctttagttaattagattccatttgtcaattttggcttttgttgccattgcttttggtgttttactcatgaagtctttgcccatgccaatgtcctgaatgatattgcctaggttttcttttagggtttttatggttttaggttttacatgtaagtctttaatccatcttgagttaatttttatataaggtttaaggaaggagtccagtttcagttttctgcatatggctagccagttttcccagcaccatttattaaatagggaatcctttccccattgcttgttcttgtcacgttttccaaagatcagatggttgtagatgtgtgctgttatttctgaggcctctgttctgttccattggtctatatatctgttttgataccagaaccatgctgttttggttatggtagacttgtagtatattttgaaggcaggtagcatgatgcctccagctttgttctttttgtttagagttgtcttggctacacaggctcttttttgattccgtatgaaatttaaagtagttttctctagttctgtgaagaaagtcaatgttagcttgatgagaatagcatttaatctataaattattttgggcagtattgccattttcataatattgattcttcctatccatgagcatggaatgtttttccatttgtttgtgtcccctcttttttctttgagcagtggtttgtagttctccttgaagaggtcttatcgcatcccttgtaagttgtaattccaggtattttattctctttgtagcaattgtgaatgggagttcactcatgatttagttctctgcttgtctattattggtgtataggagtgcttgtgatttttacacattgattttgtatcctgagactttgttgaagttgtttatcagcttaaggagttttagggctgagatgatggggttttctaaatatacaatcatgtcgtctgcacacagagacaatctgacttcctctcttcctatttgaatgccctttatttatttctcttgcttgattgctctggccagaacttccaatgctatgttgaatagcagtggtgagagagggcatccttgtcttgtgccagttttcaaagggaacgcttccagcttttgcccattcagtatgatattggctatgggtttgtcataaacagctcttattattttgagatatgttccatcaagacctagtttattgagagtttttagcatgaaggtgttttgaattttatcagtccttttctgcatctgttgagataatcatgtattttttgtcattggttctgtttattgatttgtgtatgttgaatctgccttgcatcccagggatgaagctgacttgatcatggtggataagctttttgatgtgctgctggattcggtttgccagtattttactgaggatttttgcatcgatgttcatcagggatatcggcctgaaattttcttttcttgttgtgtctctgccaggttttggaatcaggatgatgctggcctcataaaatgagttagggaggagtccctttttttctattgtttgaaataatttcagaaggaacagtatcagctcctctttgtacctctggtagaatttggctgtgaatccgtctggtcctgggcttttttggttggtagactattgatttactgcctcaatttcagaacttgttattggtctattcagggattcatcttcttccttgtttagtcttgggagggtgtatgtgtccaggaatttgtccatttcttctagactttctagtttatgtgtgtagaggtgtttatagtattctcttatggtagtttgtatttctgtgggatcagtggtgatatcccctttatcatttttttattgtgtctatttgattctcctctcttttcttctttattagtctatctagtggtctatctattttgttaatcttttcaaaaaaccagctcctggattcattaattttttgaaggtgttttcatgtgtctaactccttcagttctgctctgatcttagttatttcttgtcttctgctaggttttgaattcgtttgctcttgcttctctagtttctttaactgtgatgttagggtgttgattttacttctttcccactttctgatgtaggcatttagtgctatacatttccctgtaaacactgccttagctgtgttccagatattctggtacactgtatctttgttctcatgggtttcaaagaacttggttatttctgccttaattttgttatttacccagtagtcattcaggagcaggttgttcagtttgcatgtagttgtgcggttttgatgctctacatgtttagagaaacttctctagtaatgaactatagaaatgatccctgaaagtactcttctgataagttcttttttaaaaaagtaaacgtaccagggcactctctaattgggatcgtttctctctgtattagtttgttagggctgttaagaaagcatcacaaactgagaggcttgaacaagagaagtttgctctgtcttgcagttctgtaggctccaagtccaagatgaaggtgtcaacagggttgttttttttctgagagctgtgagggaaagatctgttccagtcctctctccttagctggtggatgtctgtattcatgatcacatgatgttctccctgtagtacacatctgtgttcaaatataagatgagagatggaggggtggaggagagaaaaaaagagggagggcgggagggagagagagagagatgctatgttgttggctttgaaaatagagggggggccatgagccaggaaatacatgtagattctagaagctagaaaagataaggaaacagactctctcctaaaaacatttgataacaggtaccgagctgggagacttggagcagataagagctgtacttagatttagcaaaactgcatcttcgtgatgagccagactcaaggatgataaagtccactacttggaaggatcatggatgcagccttgggtttaacttgaagtcattcactgagttcagataccagactgactctttccataaggaattgcctggttaggtgagggtagaaattcaacaatgactgttgcattccagaagaaggaaggcaaagagccaaactccaagttgtgctttgggaatgttgtgattataagtaagtgcatcagctccaggctccccagtgtcacatgcacacactatggggactgatcgtgttgattctcagtgaggtgtcttggggaccctgtcccagctgggaaggtagggatgtattagaaggcttggtgccaggtgcagaaaggggaagattctggaggccaggcacagtccatgagctgtagccagagatatggcatgagaataacatctaacttcccagaaaaacagcacagccaagccaggcatcagtcaaggatcacaggaggagagatttgcaggaaagcaaggttcctctacctgggtggcaaaatgccacagctgctgaggcttccttgactcttgcctgcttgaaactggcaaagcagtgactgctggtggctatgaatgcttgttaaatggcccattcttactccctgactggcctgtgcccaggacctctgcagttggatagaaagacagtgtctctagggtaaggcaggtcagaatcaaacacaaattccactcagtatgacctgtggctcctgtgcaagctaacgtcaccctctcagcctcagtttcatgatgtaaaaaacaggaggaattctgaaatatttgaagcagctgtgaagcaagggccaattgaatcaataaatgtgaatgtggctgggcgtagtggctcctgcctttaatcccagcactttgggaggccatggtgggcagatcatgaggtcaagagattgagacaatcctggccaacgtggtgaaaccccgtctctctctactaaaaacaataaaaatgaaaaaaaatttcaaaaattagctgggtgtggtggcatgcacctgtagtcccagctactcgggaggctgaggctgaagagttgcttgaacctggggggtggaggttgcagtgagccaagatcctgccactgcattccagcctggttgcagagcaagactctgtctcataaataaataaataaataaataaataaataaataaataaataaataaataaatgtaaacgtatccaatacagctcctgattcttcatggaggcaaaaagatgaatgcccctctcgtcacctcccccttttgatgtgtggagggcgatggctgcattttcatctgggacagtgatggagatagaaggcggcagtgaggaaggaaaaggagggaagcaaagactggcaccccaggctgtgcaatgactgctgccaggggcaggctcatgggatgatggcaggagggatggggagctggctttgaagtcctggactgaagccagaatggttctcatgctcccgtagcaagtgctccgaggccagccccagcaatcaacccaactgagggcagcacagaagagtctggacagcccactccccgccgtattgatgtgcataattagcctgcaggtgcaccttgactgggggacagagagataggcaggccagctggcaggctgcccccagggatatgggtatttatccatgatcagaagggcacaagcgagtcacgtgcactttaaagatcattcagttggtttttttattcaggcttaaaaagatgtaatccagcctgaaaagattccaggggcaatgaggaattcaaagcagagccggctattaggtgaccatgatgcttggagaatgtgggggcaaggaggagtcctgatgcatggggtcatggagagtggtgggagtgagatgggcactcaggataggcttggagcacgtgggaggctgagagcctggggactgtggaatccaacctggaatcctcttggatggactgggagactcaatgccaagagatgagacaggatgggactaagagcaaaggccccaggctgggaggagctatgtgtcccttctctctacccttctctccctctcctttttgtgcctcctcactaccccatttcacaccccttccaggcagccttgtgcagtccggatccctgtactctaaggattgtcacaagcatacttgcgttctttatttatgatgatctattaacaagaataaatggttgtgggtcagataaagggctaaaaatcaaaagtcatccttaacatctttaagatgctactatgtatcatctgtcagggcatgagggtcttcatcaggcccactaaagaatcccatttctcttgaaccaagtgtgtcatgactgggaggaagacaagaccatttggggtgtgaagttttgggctagaggcccttttaggagccaggttagcccccagcttccccaagaaaccaagctgcccccctcatcctcgcctaagcaagcagctgatgacaaaaccggagttggcctgaggggttcaaaggaaaaccataaatagaccccccaaaataagaaaatcatgtaactaaattctttccactttatgccagcagtcaccacacctcctgtcctctgtatctcagttttaggtctttttttttttttttttgagacagagtcttgctctgtcgcccaggctggagtgcagtggcaccacctcggctcactgcaagctccgtctcccgggttcacgccattctcctgcctcagcctcccaagtagctgggactacaggcgcctgccacagttttaggtctttattctgtgttcctctttatttttttcccagtccctttttctgcatctctcagaatatacactaatgtcctaggacagccgtaacaaagtgccacacattgggtggcctaaaacaggaggaatttattttgccatagttctagaggccagaagtctaaagtcaaggtgtgagcacggtggtctccctctgaagctcctggtgggagtctgcttcgcctctctctgtggctgctggtggctgccttctcagtccctgttgtcatatctatcataccgtgttctccctgtgggtctgtgtctgcctctctgggtctttgtccagattttcctcttcttataagaaaaccagtcattgaattagagatcattgtaatccagtatgacctcatcttaatttgatgacatctacaaagttcttatttccaaataaggtcacatccacgggtactgggtgttaggacttgaacttaccttttagggggacacgattctgtccactgtgatggatatacgtgtattcccccacatgaaacagtactccacacatagggaggattcaatcgagacttgatgccaaaacttagtggcccaaagtggcaaacatttatgatttctcatgattctgtgggggcagctgtgcagctcttctagtaaggagaggcactctcttgattctcttaagtgtctgggcttcaaatcggatggcaggcacaactgggcctcagcacatgctctttaccctctggtggactagcctagcctagtactcgggtggtggacccatgtcccaggaagccacaatgctcatgcccttcccaactgcttgcatcacatctggcaatattcctgtgactaaagcaagttgcatggccaactccagattgaaggagtagagaagtcaggggagcagccaagtcacgttgcacaggacatgcatgaggaatgagagaatttgttgcagccattttttgcaaatagtctaccatagaagctgagtgacatgaccttttatatatgtggaagagtaacaatatatacacatgggctgggcacgatggcttacgcctgtaatcccagcactttgggaggccgagacgggtggatcacgaggtcaggagatcgagaccatcttggctaacatggtgaaaccccgtctctactaaaaatacaaaaaaaattagccgggcttggtggtgggcacctgtagtcccagctacttgggaggctaagcaggagaatggtgtgaaccccggaggtggagcttgcagtgagccgagatcatgccactgcactccagcctgggcaacagagcaagactccatctcaaaaaaataaaataaaaataaaaataaaatacacacacatacacacacacacacacacacacacacgaccatttgttgggcaatctttcttacaggctgaattgtaaatattccagagataaatcgcacagacttgggagttatatcgtctggcttgcaatactacctctaagatgtgcaaactgtatggcctttgaccaacctttctgtgcctcagcttcctcatttataaaacaagaataataatacctccctcctatggctgtgagttgtaggataaaagaagttaaaatatgaagtgtttagtacagtgtatttgtctattcttgcattgccataaagaaatgcctgggctgcgcgtggtggctcatgcctgtaatcccagcactttgggaggccgagatgggtggatcacttgaggtcagaaactcaagaccagcctgaccaacatgatgaaaccccatctgtgctaaaaatacaaaaattagctgggcattgtggcaggagcctgtaatcccagctacttgggaggctgaggcaggacaatcacttgaacctgggaggcagagattgcaatgaaccgagatcatgccaatgcactccagctagggtgacagagcaaaactctaactcaaacaaaaaaaaagagactgagtaatttataaagaaaagaggtttaattggctcactgttctgtaggctgtacaagaagcataatactggcatctgctcagcttctggggaggctgcaggaagcttagaatcatggcagaaggcaaagagggagcaggcagctcctatggccagagcgggaggaagagaggggggaggtgccacaaactttcaaataaccagatctcacaagaactcactcattatcgtgacagtaccaggaggatggcactaaaccattcatgagaaatccacccccatgattcagtcacctcccaccagaccccaccttcaacattggaaatgacatttcaacataagtttttggcagggccacatatccaaaccgtatcatacagtgacatgcataaagcaattactaaataagtgctatctgttttaatttaattcccaacttcttgcatcagatctgccaatattcctgtaactaaagccagttgcatggcgaacaccagattctaggagtagagaagtcaggggagcagcaaagtcacattgcaaaggacatgcatgaaggatgacagaatttattgcagccattttttgcaaatagtctgccatagaagctatatgaatatctcatttcaagatgtatgagcatctcattttgctcttaaattcacatcagtaaactttggaatcccctacacaactcgcctataccttggggggccagggtgctacctcagtcctgctctctgccttatctttttattgcagcattttcactctgctgtggcctctcagggtaggggagaccttccctttccttttctccactcctaccaatccagagtttctatcatctaaaccatacccaccctcaaatctaagattcctctcaagaatccaggcaacatctttttaaaaacttttttattttttatttattttttagcaggtggggacagagcctttttatgtcacccaggctgaaatgcaatgacatgatctcagctcactgcaaactctgcctcccgggttcaagcaattctactgcctcagccttctaagtagctgggattataggcatgcaccaccacgcccagctaatttttgtatttttagtagagacagtgtttcaccatgttggccaggctggccttgaactcctgacctcatgatccgcccacctctgcctcccaaagtgctgggattacaggcatgagccaccgtaactggaccctaggcaacatcttaacctcatccttatcccccaaatctctccatgtcctgcccactgcatcatctcccttcctcttccatgttgtgggaactctgtcctgagccatattctaagtcttcacaccatgtcttgtggcaaaactccatcattagacctccaagctttgttctgccttaatgcagaaggaggctttgggaatttagaaaactctcttccctctcaattgtcctataaatccagactttcaaatgaaatgcttaccatagacttgagaaacaaatcagaaactcagagcaaaaccctgagtctttattttaggctgtatctttctttgaagcaatggctgccatcaactccgtgtgtgaaggagacacaggacaattaagaaacaaaaatgagcggtggtgttgcaggtgctgttggtgcctgcctggagcctgtcacctccttaccatttcctggcagcacttccagctgcccagtagcaacacttcccctaaggactctctttggcaggtgaaagtgcctgagattgactcctgagagcagccacggccagtgacagccggaggtggtgatgtaaacctcagctagctaggctttcaggaagagtaactgaggcagggtcctgctctggttctcagtgtctccaagagatgaagctgccatttctcatagtggcgacttgctataatgtgcccttcattgaccgtcttccttttattgttcacttgcctcctttcctgcctgtgtttcctgaaaccaactacctcacataaactacttttgcttgaatccctgtcacagagtctccttctgggggattctgaaggtagacacatttaatatgtcaaaagtattgcacctgttgtgtgttttaggggagtgatgattagcagaaaatagaaaggaggctattatagtggtcctgggcatgggagaacaagagcaggtgctgataaaatcaggagaacttgaatagtggcagagctggcagaaacacggaggatgtgtcggagggtctggtgtgcggttgctccccacagcggagtctgagcaagaaaagaggctctggcctgatggcaagaagacctcacggctgtttcttgccattgctgtcactgtcatgttcataggttcactgcccatagcaactgaaagaatgtcaaatgcttgcacaacccccttcaatttgtagatgaaaactggaagtgtggacaggttaagtggaagctcaaggtcataaagccagccagctgcagaaccttgcactgtaagtttttgttcgtgacaaggcccagctccacttcaggtgcggttcagatttttgtcttcattcgttctataaaacttcattttttgctttttacttctcgactcttctaattgtcctttgtatgtctattaggtgtgggtcccccattaggctgatctgtagcataatttctacaataggaaagggagataaataggacatttaagatgcctggactcatctaaaggttgtttaaaagcaattactaccattagtttgaagcctacctctggctactctgatagtaatgtgcacccagcaatccaattagtttggaaatggattagtctatttgttaccaatgtgtgtggtttaaaatcagtataatatacatctaaaggtgtgtccattttatctattgacactttgtataaatgtgttgcttcatctttccgtaggtaatttactcactcccttctcccatactaaatgtttcttcattacaaattgatttcctaaactatgattcatgatgtttcagtttcattgtctttattaaatgactgtaattctttctttagttttaaggatttccattttgtgtcaccacattggactaaccatggacaaccagattttccatagaatgaggtcattttctgggaactaacagaccaaggaataccccctgatatactacattggaggaatccttgcagatactctctccaaatgtgttaaataaataaaatagtatgttcatcaagtacctctggggtaccagaagcacagataagctggtgtccaacatggagcaagtctggcattgaggtgttagaagaaaaaggctgggctccctgaactctgttacatggtggaggctgaggggcctgttgtgtagattcaggtgcaggccacgtgacagggtgttagccatgtaagtccatattttctcccattgcttcacatctatttcatctattacttcattcattcaacaaatgcttagtgtctattatttaaacgtttctggggatatactagtgaacaaaacacttgcctttcctccttgcttccctcttctccccttctctcctcctttccttccttttgtaattctttactccccgctttttaaaattgagcttattttcagggcttcctttgaacatctgcattcttatccagttttggaacactatttgtgttgttgttgttctgttggacagggtctttctccgatgcccaggctggagtacagtgatgtaatcatggctccctgtgacctcaaactcctgggctcaggtgctcctctcgcctcagccttctcagtatctaggattacaaacacaagtccctgcacccaatctataaaagtatttttttaaataactgcatattttatcacatattgcctcaaatcttgttggtcctcttgccaaattgtcagatattagtggagacacaggtcagtttcccaaggaaaagcattaaacgtggtccctgcctcttgctgcagcatttggctgcaggaatgtgtgtggattccaagccagagggagggccccacctcattaagccgacctaggggagggccccagctgtgctcagtcaggaggaagaggtgagctggctttggagaaaagaagaggttacagcagaaaggaagcacccattcttgacagagtcttagggagccttctctcctttctggatacaaagcttcacactataataaaaccatgtggcttatgtagttaattggtagattattattaccatgtacaaagtgctgtcaggagtgcaaaagaaaagatgacctgcactttattcttgttttgactcttcttggagttttgtctattgggatgtttgccatccagttgggctatagagctaacaatgaatagtgtgaatttgctgcacagtgagctggtaatgcagcagataagcagaacagaggcatcagatcagtggccgaggagatggggatggggtcatttatattatgaatattggattacaaggaggtgatgcactctgcttgcttcaatgattttttaaatgtaactttgtctttttttgtcttttaaaaatgtaacttaattttttttacacaaaatataaacatgaatagaaccccacttaagaaatagaaaagtgtccttgaaaaggcccctgtgtgctcctctccaatcacgtccccaccccaccctacagtaggaacccctctcctgaactccttgttaactaatcctcaatgttctttgtagttgtaccacatgtttgtagccttaagtaatattttgctaagatgtgcatgctcttgaactttatgtaattagaatcacagaggaagagttcttctgggactagctttgttctccacattattgctttgagatttatccatggtgatgtgtgtagtttgttcatttattcaacaaataaattttggaggcaaatactgagtgccacacatggtttctggctgctggggatacagtgtgaacaaaacaggcggaagccttcatcttaaggtagctttattctagtgggtgtgggagagcaatgcatcagataaatgaatatgtagactagtagattgtaattagtgcaaagaaactgaagcagtgaagaagagtaattttaagggagacgtggagtttcagataggctagagtcggtctcgctgagaaggggcacttgagtgaaacctaaacgaagtgatagagtcctggggatgtcagcgggggtggaagagggcttttcaggcagagcaaacagcaaacaccaaggcctgcagcagcctgtgtgacaagagcagggttagcaagggagggacaggaaggggagatagggacagagaggatgttggaggtttttgaacagggtggcattatatgacttatgctttaacaagatttatctggctattgtgttgagcatagagctgaaggggcatggggactggagcgagggctccaggtgggagtcattttagtcattctaacgagagatggtgtggacatggggaaaggagcagcgtgctgggtgcatcacaaaggctgagtgtaggattttctgataggttggatttgaggtgacagaaaaagtgagaaatcaaggactgtagcctgagcagttagaatggcagagggactgctcatcgagtgagggaaacagggcagggaaggaagatcaggggctcagtaaaaagaatgttcggtttctgatgcaaattcaacatcctggtgcagatgtgagcaggcagttgggtgtagaagtttggagtttagataagaggtctggatcagacatggaaattttgttgctgccagcctggagatgatactaaaaaccttcagaacgggtgagatcaaagggagaaagggagtgagtacaaagagactgggaaagaaagaaagtccagagactgtgttctgggatccttcaaaacgtagaaatcaggaagtaggaaccagcaacagagacttagaaaaagcagcaagaaaattcctatcagagggaaaccatgcatgatcaatagtgtcaattatcactgctacagcaaaacacaggccactggtgactgcaagagcatgttcagtggagtggaggggacaaaagccagcttaaaatgagagactaggaggctgagggagaaagtggagccaatgaggtcaggcatggtggctcatgcctgtaatcccagcacattgggaggctgagatgggtggatcacctcaggttgggagtttgagaccagcctggccaacatggtgaaactccatctctgctaaatatataaaaattagctgggtgtggtggcgggcacctgtaatcgcagctactcaggaggctgaggcaggagaatcacttgaacccaggaggtagaggatccagtgagctgagatcacaccactgcactccagcctgggtaacatgtctcaaaaaaggaaaaaaaaaaagaagaagaaagtggagccaatgaaggattagaggggagaggctacgtgggagaaataacaaggtttcagacagttacaggccgccctttatacattcctctgtaggtgcacatttaagtcagttccatctctcagcttctgtgaacagcgctggagtaaacatggagtacagacatcccttcaacacactgatttcatttcctttagatctatatccagtaatgggactgctggctcatatgctatttctatttttaaatttttgaggatctttcatgcctctttccataatggctatacttatttacattctcaccaacagcgtggaagagctctcttttctccacatcctcaccagcatttgttaaattttttgtgtgtttttgatgataaccattctaaggtgaagggatatctcattgtggttttgatttgcatttccctgatgattagtgatgttgagcattttttcatatagctgttggccatttgtatgtcttcctttgaaaaatatctattcagatcttttgtccatttttaaatttaattatttgcttttttgatattgagttgtttgagttccttatatattatggatattaatcccttgtcagatgcatagtgcacaaatagttttttttccccattctgtaagttgtctcttcaatctgttatttcctttgctgtgcaaaagatttttaatttgatataattccatttgtctatttttgctcttgttgtctgtgcttttgaggttgtctttaaagaatccttgctccattccatgaagcatttcctctatgttttcttctagtagtttcatagttatggtcctaacacttaagcctctgatcttatttgagttgatttttgaatatggagatagtgatctagttacattcttctgcatgtggatatccagtttccgaggaccgtttattgaggatactgtcctttccccaatgagtacttctggtgcctttgttaaaaatcatttggatatacatacatatatttatttctaggttctgtattttgtcacattcatcaatgtatctgtttttacgccagtgtcatcctgttttggttactatagctatgcagtatattttcatcaggtagagtgatgcctgaagctttgttctttttgctgaagattcctttagctctccaggatcttttgcatttccatatgaattttaggattgttatttctattgcagtgaagaatgtcattgagatttttattatagagattgcattaaatctgtagatcactttggataatatgtatatttttaaacattatttcagtccatgaacatggaatatctttctaattttttgtgtcctcttcgatttctttcattggcgttttatagttttcattgtagggatttttcacctccttggttaagtttatttataggcattttatttataccttgtaactattgtacatggaattactttttcaatttcaatttcaaatagtttgctattggcatatagcaaacactactgatttttatatgttaattttatatcctacacctttaccaaattcatttattagttctaatattttttttttgatggagtctttaggcttttctctaaccatctatctaattatgatgatattgtctgcaaacagggaaaatttgactccctcttttcttaatttggatgccttttctttctttcccttgcctaattactctggacagaatcttcagtgctatgttgaacaaaagtggtgaatgtgggcatttttgtcttgttctacatcttagaaatgaagttttcaactgtttcctgctcagtatgatgttctctgtggatttgtcatatatggcctttattaaattaaggtgtgttgtttttataaccaatttctggaggatttttatgaaggaattgaattttatcaaatttttttcagcatctattgaaattatcatatggatttggccttgattctgttaatgtggtaatattatgtttattgatttgtgtatgttgaatcattcttgcatctctgtgatgaatcccacttgatcatggtgaattatctttttaatatattattgaattcagtttggtactattttcttgaggattttttgcatctgtattcatcaggaatattggcctatagcttccttttttgttgttgtattcttttctgatttttggatcagggtaatgctggcctcatagaatgagtttggaagtgttccctccttgtcaattttttggaagaattggtagaattcttgtgagaaagattagttgtaaatcttctttaaatgtttggtagaatttatcagtgataccattaagtcttgggagttttttgaatgggagattctttagtactgcctcaatatggttattcattattggtctattaagattttctatttcttcatgatttaatcttgctaggttgtgtctgtccaaaatttactcatttcttctagattttccaatttcttggcatatagaaatttacaataggctcttatggtcctttaaatttttgtagtatcagttttaatgtttcctttttcatccctgattttatttatttgagtcctttctctttttccttagtctagcttaaggtttgttgttttttttttatttaaacaaaaatacctccttgttttcttgatcttttgtattgtttttaaaacctctattttgtttatttctgctctgatttttgttatttttccccttctaatttggggttcagtttgtccttcttttctaatttcttgagttgtgacattggattttttatttgagatctctctacattttggatgtaggcatttatcacagtaaaattccctcttagaactgcttttactatatcccataggttttggtatgttgtgtgcatattttcatttgatcgagaaatttttaaattttatttttgatttcttcactaactcctctgttgctcaggagcgtgttgcttaatttccatgaagttttacagttttgaacatttcttctgttattgatttttagttttattccatggtggtcagaaaagacacatatgattttgatttttaaaaaatttctaagacttgttttgtgactttcataatctatcctggagaaaatatcatgtcttgttgagaaaaatgtgtattctgaatctattgggtggaaagttctgtaaatgtctgttggattcatttgatctagaaggctgtttaaatccaacgtctctttgttggttttctgtctggataacctttccattgctgaaagtaggggtattaaagttccctactcttattgtattatagtcaatctacagacctttcagatctattaatgttttccttacatatttgagggtctcaaatattgagagtcccagttttgggtgcatacatatttacaattgtaatgttctctttctgtattgatccctttgtcattatatcatggtctttttgtttattttttaccattcttgacctaaagtctattttatctgatataaatattgttattcctgctttttttttttgcttcaatttgtttggaatatcttttttccatctctttagtctgtgcatgtttttataggtgaaagatctcttgtagacagcatataattgggcatttttaaaaatccattcagtcactctatgtctcttaattggagattttaattcatttgcatttaaggttattattgttaggtggggctttactactaccattttgttacttgttttctggttgttttatagatcctttctaccttgtttcatctcttattgttttccttgagagattttttttttctagtagtatgttttgatttcatgctcattatttttagtgtatctattataagtttttgctttgtaaataccatgatgcttaaaatcatgttatagttaaaacaagttatcttaaactgattaacaacttaactttgactgcaaattaaagcaagaaaaacaaactacatttaacaccatcccacacacgttcatttttatttttgatgtttcaatttacatctttttatattaactcttaactaattgttgtaattactatctttaataattgtttctttagtcttcatacttaagatccaagtggtttacgttccacaattacaatattatagtattctaaatttgtctgtattcttacttttaccagtgaattttataccgttagatcttttcttgttacaaattagcacccttttctttcagatgaagaactcttgtcagcatttcttgtaagacagatctgatgttgatgaatttcctcagcttttccttgtctgggaaagtctttatctctccattgtgtttgaaggatacattttccatgtgaactattcttggctacaaggttctttcccttcagcactttgaatatatcatcccaatctcttctggcctgcagtgtatctgttgagaaatctgctgaaacttgcactggggctcaggtgaatgtgatatgttttctttctcttgctgctttgagtatttcttctttatctttgctttttgataatttgatgctgtgccttggttaatttctctttgggttgaatttgattggtgatctctgagctttttatacttggatactgtcctttttctccagatttaggaatatcttagcgattatttccttaaacatgctttctagaactttttctcttttatctcctggggaactactattatatagaggttagtttgcctgatagtatctcataattctcataggccttcttcaatctttttttaaagatttttctcctctgattgggtaattttatatgttctgtctttgaggttgtgggttctttaagtctgctattgaagatttcgaataagcttttcataaatttcaataagttcagttattgtattctttattcttaggatttctatttggatttttaaaaagtgtttctatttacttgctaaatttctcaaattctttcaaaatttcactgcattttccatccacattttcttgtgactccctgaaattaaagaggattattctgaattctttctcagacatttgatagatatttaattcttctgggtccattattggagttttgtttgtttcttttggtggcatcatatttccctgagattgtttttgttgttgttttgttttttttaaacaatttttgcgtgttttatgatgatgcctgcatatttgaagagaaagccactcttccagcttctgctggtgttattagtgttggacctctactacttgatattgggacttaatcactgccctgccattgtttcccagtctagggaacacttatagtgagcactggaacttaaacactggactagaactaaattgctactctactattgtttcctggtctgggaaagacttaaatacgtactggaacttaatttccaaaggaacttaatttccaaactcagttgtttccaggtcaggggaagactccacatgagcacctgagctttgtgggaagtctggccagagattcagaccttcctgccgatcatgcttcctgcagcactatagtgctggccggtctcctcagtatgacatctgcatccctgctgattggagctccaagattccagcaccaagtgatcagcacccccactttttgtccccagttcaccccaggtagttcagccctcctagctctcccaggggttcctgtgcagtgagacctgagtgggcttcccatgaagattcccatactggtagggggatcaaacatccacctccaattccatcttcccaccttagaaaccatgagtctgtgtcaattctctgtgagtggcattatacaagcctggagaagagagtggcacagtctgaaatgaccatttttcttagttattatggcctagtgggtttctccacttctccccaagttctggtgaattcatggtggtattcttgtcttttaatagtttccagttgtatgtttgtggaggaaataatgtcagggtgtcttctattctgcaatcttgctcatgtttctccttcataattactgttactttttatagaattgtatttagatctattggtcagcagatttgattataagaaattttgacctatttacatcatgagaacaaagaaaaattttgagaaatgatagggagaattcctcagatcaaggacttgtgaaagatcctgagaactgttgaccagacagaaacatggtatcagaataactctcttgtatcacaaaatttttttttaaatgtacttctttatctcaaattttaattttttaaaatatacatttgattgtttttttcttctagtataagcagatcctcactgcatgttttggggtgtgaaattcgacatctctagcaggttaacctcttgtattatgtcagagtggggaataagctcagaaaaatataatttatggagaacattttctcattttctgggaccttgtaaagaccttatttgttccaggtgacaggccccaagtggaataaaaggccattattgtgagaaatgacaactcagatatagcaaagttgttgccaggagttgatgatgcagaaacaatttattttgggcaagatggtattgaatggggagtctattagtggtattttaccatgtgaatttctatatgaaccatgtctgtgggagcactgctgcattcatttgtgggatgtactgctttttgctagttgccgtcaataaaatctgttctgtagctcttcaaagtggttgattcagccactctgtattcaggccataaagatcatgaaatgaaagtcttctgagctccaattagagtggaatgttatatctcaatgcagaagtcttcttcagtaaagtaagtgtaagtataaatttgtttagtgaaaagtaccttttggaaattgtacttttgagacagaggcattcaaactctgactaccgcttgccaggtgggtaatttaggggatactgcttaacttttttgataattgtatttcctcatctttaaaataaaaataatgatgaaaatgttaattaaaaggatgatgatgatattgacaataatggcaatgatgatcatgacagtgaagatggcaataacagtaacaatgaatctggtgatgatgatgacaatctcaaacaactgttgtaaggataggacgtaatccattcaaagtaaccagcacagaccctggcccactaaagggagatcattaaatttcagctgcccttaactgctttctcaaacctctactctgttttctggattttctttatttgtgtatatgtatcagttttatattgctgctgtcacaaattatcacaaacgtagtggcttaaaacaacatacatttattctcttgcaactctgaaggacagaagtacaaaatcactttcactggatgaaaatcagtgtgtcagtaggaccatgtcctttcagagtctgtagaagagaacccattcccttggcttctccagccctacagtggtgctcctcatattccttggctcctgacccctttctccatctttaaacaaattcattaaagttgcaggatacaaaaatcaacatacaaaaattagttgcatgtctatgagctacaccaataatgagctaccagaaaaagaaattgggaaatgagctgcatagtgaagtaatcagaaatcaattcactgtccttagttctgctgggacctcctgttcaggatttggcagtaccagtgacaaaggctaaagctgcttggaattatatattctccatcttaaaatgccaaggttaccttggacttcaacctcagatgtcgcatgtgactgtctaggttgtacataaagatacgaagggtgcccattgaagttggccagtgcacaacttgtgtggctgtacgtggtgggctttttctgatgcccaccagactaaaaactctagaaatgtgtgatctctatctatcttgtattctcagcacctactgcagttcttggcatacagtagaaattctcatttaaggaaatgaaggaatgaacatataggaatagtcaatacaagaacactaagtaacacctcatctggagttactcaggtcagtatactgagctgctcattcgaatcacctggtggaaattttaaaaaataaaaatctcagcccagatcctattgacagacattctgatttatttcatctggatggggctgcagtattactgcttttctaagaagtatccaggtgaatctaccgtgcagccaggtagctagaacctgctagtctggaagagtggttctcagacttcatgcattaaatttacccagtggacttgttaaacacacaggtgacttttcttactctgtcactctgagtttgggggctgagatattgcatttctagtaatcactcaggtaaggctgatgttgttggtatggggaaccatggtttgagaactgctattcaggaagacagcagagaagataagttcctttagtgtgcataggtggaaaacagttggtagagtgattctggaagagtgcatgcatgtgcattcacatgttttattaacatgtgaatatgaaagatattaagcacccatttgtccattttaaatatataattgtatcccttctgtccaacagcatttcactgtagacatttttaagtgtcagttttttagctgaaaaactagaaaaccaaggaagtaaatcattgcccaagctagacttgatcttttcagcatgtcagagtctcatgctttagaaaaccagagaccactctcactattttgtgttcatcctctttctccatttccagtcactttttctgcactgacttcaggttaatcttccataagagggccttggtgttctcatcttattcctatgcccccactaaattctgagtaagtgtaacagcctttgtccttctgcatgccacacagtagttacctagctaagatattgtcaatcagtttgagagactataagctgcctaacctagagttggaggataataccaatctgagatcttctgagcttagcatcattatcaacttctgttacttccactaaaacctttgtaaatcacagcagatatatttcagaactgtgccacttatctcagtgcctccaggcatttcaaagtagtcacttcacacttgccatcctccctgtccttctgagtcctcctctcagccccagtgtgtctaccacctcaaagcctatggttgttagcctgccttacttgggtcaaagaccttgactccttccagatggatcctaaacttcccttccattcactttatccaaaatgaaattgtacattcttgaaatacacagcagcactcaacaaatgctgaaaattatatgattaaagtaatttgcactcaaatgtaaataaggcttgatgctccatggaagttttgaattttaaagaagagctttttattcccaatggctctaatgtgtgggaaacatattgggggaggaggcacatggggtcagcaaatgctgtggacaattctctgccctctttacctgggctgccgttagtttgtctggcagggactgaatatatggctttaatattctggccaaactatctcctcatctccccttagctttgcaaagtggctgcagtaaaacctgccatgcttggattggcacggctcaaagctaactgtatttgaaacttcacatttcaaatctcgaagaagacttctgtattaaatttagagttttttatcctcaaaggagttgtacattttatttgtgtcaaaatttacagagcactgtcttaggcgctttctagcagttgctttaaagggttgtcagctccaggcatttcctctgcccacatacaggtgttgtcacatgttcccaggtgaggagttagcaagggtttgctgtagctcttggtttaaatgttggcaaaaaaaaaaaaaaaaaaaaaaaaaaaaaaaattacacctgcatcatctagaggtggcctttcccaatggacatttccacttgtgatgatggactgaatattgaaaatcatttctggaaactgtaaagtgaaagaagccactgacactgaactgcctgccagaatcaggagataatttcttttctgggggaaaaaaaaaaaaaaactaattctctaagttttaactgatttcgggaagttaaaactacagtttatccccagggttatgggccaaactgtacttttaaaaaaattatatgttgaattcctaacccccagtacctcgggatgtgactggatttggagatagagtctttaacgaggtgatgaagttaaaataatgtcattaagtttggctctaatgcagtctgactggcatccttataagaagaggagattaggacaaagactcacacagagggatagccctgtgaagacacaggaaagagagaggccccaggaagagccaatcctgcagacaacttggtcctggacttctagcatctaggactgtgagaactaaatttcagttgtttaagccactcatctgtagtgctttgttatggcagccccagcaacaagaaagttgttgtcaaagaatacatccttttgctggaccagcctctctggggctgccccttccctgagcaggtggatttctctgtccgactcctcaagggcatggcccccacctccccccagcattgctgcagacagtgctcctgccattgtcctcttgtcgcctgtctaggtttggttgtccttgttctttcctctttgcctatggctgaaattaagaatggtgacaagataagactataatcctctcctttagtctcagtacaaataataccacattaaaatctggagaaaaggaacatgatgatccatgggaaggacagccagctctgtaaaagcatcactggacgctagcagaaatggtgcactccccaccagaactcatgctcccccttcttcctgcagggttggagctgggaagcagctgcccagacacaggctgtggtttccatccctctccttgttggggattgtccgtgtgactcgcccctgctgagggatggcgagttgaagtgatgcaccttccaagccttggtagtgaagcaggaagtgtgtttctctgcattctctgctatctggttctaggactttgcttctccaagtgtggtcccctgactggcagcatcaacgtcactcgatgatttgtgagatgcgcaaaacctggggcccattcctgacctactgaatcagattctctggggtggggccccgcaatctgtctttgaacaatcactctaggtgattctaattgacctccactttgaaaaacactgggatagaggacatgagaggtctccaaaaggcaagaaccaaggttcctgaattgttgtgtagaggaagggcacccaccaatcatgaacactactggggtgaccttcatgtgactcctaagcaagatgtaaatgcctgttagcttggaccactgaaattctggggtttatttgttacaacagttaggattgtccttaatgaagggcagaagaagatgcgattacaattaagtggttacagaaccagctctgggtccctgatgcaactctttcccactgtttgctttaggaaaagagcaagagttagaatttcatgcattggcatggtctacctgcaacctgttgtgcattttaatttaatttagtttcttggtaaaatttttaaaaccttatttggtaacctctcaaaagcaagaaactaattgttcttctgatgtaaaatatcaagcaaatacaatcaactattgctacttacggggagggggtacataacagagcagacccttctctttgccaagactgtcgtgaaatgcatttcacatgaatgaaacatatgcctcccactagtaggagccacagcatcccttgaaggctatcactcccctgaaatgagagctacctctcagactaaagtgtggtcagaaagggagacttgaatgggaggatcattttattgactgtgccttcagaaaaagaaggtggtttctgcatgacaggaggtaaggctgcacctcaccttgatatgggctggaagactgggagcccagaacccactcaagagccccttctgaggtcagctggatgctggatgtggccaggctctggaaagccagcagagaatgagatgctctttctgcctgcggagattgtgttcctctccctgtggcttagtgtcatcagccctataatcacctgatagtcatgacacatgaacccagacaggttgctgagtgtttttgagatggagttttgctcttttgcctaggctggagttaagtggtgcaatctcggctcactgcaacctttgcccccttggttcaagtgattctcctgcctcagcctcccgagtagctgggattataggcacctgccactatgcccagctaatttttgtattttttttagtagagatggggattcaccatgttggccaggctggtatcaaactcctgacctcaggtgatccacctgcttcggcctcctaaaatgctggcattacaggcgtgagccactgtccggccggttgctgagtttttaaaagcaaacctctccagtaactgggtaaaatgttgatgtatttccttataaagctgtgtgtctctattttttatatatatacacttgtgatcctataatatgtatcatttctgccttacagtgaaattaaagcctgccttttattttataaccaagagtcagaattcaagaaattcactagtaaagcaatccattagtaaaaataagaaattagaataaaggaaaatattgtctattgtcctaactcccataattctagaatcttccttacagtatttgttccgtagcatcaacttgctttctgattgaaatcactgtgtgactgtaattttgctttctgcttaacattttatcttaagtattttctatagtgtttcacggtctttttaaatgtaatttttgatccataatattccataaaactaaagttccacaataaactatcttcttcttgtggagtagttatataattttcaattctataagggtttttaagtaaaattaaaaagaataacttggtgcaaaaaaaaccctatgctatttaagattgtaacttcagtatatgttatagaagaaagaagcttgggcttgacaatctgtgacatcatagaaagatatttggtctttgtccctggttcttgacacaggagctcctaaaacccttgagatgtcctgaatgacaagtgtgaaggaagcctcttttgttctaatgaggtggttggaggccctagataccttcaggatggggggctgcacaccaaaaagaccaagtcacagtgacagggttggtcacaattggggaagcctcagaagaaatcaaccctgtggatactgtgatcttgaacttctaacctccagaaccatgacaagatacatttctgttgtttgagctgcccagcctgtgatatttcgttacagccctagcaaactaatatacccacggcccccatgagcttaccccctgacttttggagagagaagaggagctggaagttgagttcagttaccaatggccaatgatgtcatcaatcaagcctatgtaatagaaccaccagaaagccccctaaatgatgggcttcagaggagagctcctgggtgggtaaatatccttgagtgaagagagggtgatgcgtccagggagggagtaggggctctgtgtccctttccccataccttgccctatgcatctctcctcacatttggctatttctgagttacatcctttatttgaaactgataatactaagtaaagtgatttcctgagttttgtgagcagttctagcaaattatgaaaactgaaaggggagattcataggttccccttgactttgtattcaagttggactgaagtgtgggtagcctggggatgagctacttgcacctggcatcagaagtgagggcaatctcggggaatggagcccttaagctgggggtggggaagtctgcactacctctgggtagtgagtgtcagaactgatctgaaatgtaggatatgcatttgctcttccagagagaattggttggtgtgagaaaaaagtctgcccatttggtatcagaaatgctgtaaataaaaaatagtgcagaatgcaacagatttgggtttgaatcatgactctgtcactttctagccatgtggcctttgtgatctttcatacattagttaatatctgtcctccttcttaaaataggactaatctctaccctataaggtgctggtggttgttctttgagggctaaaggatgcaatgacatttcaaatctcttagcacagtgtgtctggaatgtaggtgggtactgcacaaatggtaaatatttgtattacaaaataggcccccaaaagtggaaatactgggcaagagtttgcagcctttttttgggatcttgacacctatagccaacttgctttctaaaacatgcacacactcatttcagatgaaagcaagtgtgttttaaacactgtggcagtttgtaacagttccttaattgctgtaaattgtatacgttccttaactagttgtatttcctccttgctacttgcctgctcatgtatcttttgaatggaatttaattcagtaaacacaaatagtcatctagcttgtatcagtgccgtactaggtgttagaaatgcaagcataataggatgcagtacttacccatttggaactttaaatcaactggaggagaaaaacacgtggatcagtaccctcagtgtgatacatgcaaataacatatatgtacaggcaaagagaacagagagtaatgaattcctttgctaatttatctctcaatgctttagcaattttttaaaaattcatttgtgaatagttgaccagtttaaatattgaaccaaccagcatttctgttttgtgacaataacaagtcaaaatccaagattctcttcttactttgtctactctcttctcttccaaaagcacattcacgtttgtctacataaatacatgagaacattcagaacccaagaaggtggactgacaaagctgagggacggtagagactgcacgtattaaacaagcaggaaaacaaccctcagagtctacattttcatacaacattagaaggaaaaaagggtattaactgaaaagaagggtgtggaaatcaagtgtgaacgagccatattgaaactctggctggaatggtgggatggaggtcccagttgaatttttcctaagaggctgcttggtaaacattatctgtagacctctccgacaattggatttacattcgaagaagcagattgaggctcaccctgatagaagaaagtgcagtgatttacacaggttggatggaagacctttctgtcctttgtgtatgcatggcttgactctaagctctggcccctttgtctcttaaagaggcctttctcaaggtggctcttgaatatttttaaaagtatttttcaaggctccctgcatccaagcatggcacccatgtgctgtgggtccttctctccctctggcccatgagtgacttatctgagagatgggtttgggaagaggaagcagcgtgccccttttcttatcttcctcctgctctcctcttgtagccccgtagcttgatctctgtagatgctgttaaagtggaaagcttcaggtgaaaatttccttggattggagactctcagtgtcatcttttgacaacatttagcgtttcttggggtgactccgatttctagatgaccccacatcgcatctaatgcacatctaagttaatcctcacagggcttactctgcttatcatttattaaggactgacatttgtataattaagttagggcccatcatctgtttaagattcaacagtaagtgatgtcggggtttacggatgccaagacaccccagctccctgcctatatttggaatcaattaacagaaagatatagagaggggtcaggtggagatcaaatatcatctgtttatgacaaagtctgagcttgacaatgtggtgctgacgggtggcagcaatggccttgctaatcctaaaccccagaaccaaaccaagccaggcccctggagcccttcccccaaccacaagcagggtcttgctgcaacttaacatggggagagtggagcagagcagagcagtgggcatggcccctgaggtcaaggaggctagaggggagaagaaaaggaggcgtgtcactttctcttcccaaactcacctctctgataagtcactcatgggccagagggagagcaggacccacagtctatgggtgccatgctcagaggcaaggtttctcagcagcggcctattgacattttgggttggatggttcttcaatgggagggactgtcccacacacagtgggatgtttggccacatccctggcctctactcattagatggcatagcactccccaaaccctccctcatgacaatcaacagtatctccaaacattgctaattttccctagggagggcaaaattacccccagtggagtaattccgcttctccaatgtgaggtctcaccaaaaagtagactgggagtagggaattgaaaccgcaaaagaaactgcaggcagcaacctcctcagtcccatcagtcagtatccagcaggctcctctgttctttccaagctcctggttcatacctcccctggcacttgtctccagcctgcctccctgtaagtgcctctccagtgggttatttacgagtgcagcaactacctggccttttgcccctccagcacctgcatgcatgtctgcaccctcccagtgcctggcacagtttgccatacctggggcctcttttgtataggtcaggaaggtaatgattttagagaaagtttctcagatacaggaagaaaaaaatagatgagagtattttcccatattaatctttaactgtcgctgtaattgcctcaaatcactttatgcatcgtctgacctgccaatcacatggatcttacccagcatagaaaagcagagactctgaaatagtagaaaaaatagcaagtgatcatcatatccgtggtgctggctccaagcccaggactcgcacaaagtaccattaaatggtgataatagtcacatatattgctttcttcacattttaagtcctctcaaaaagtgtttcatattcatcatttgtatgcatttgtcttggattcaggctagacttttctagttttatgatacaagtagctaattaggactagtataggggcaaaagtaacttattttgcaaagcatgctcacttgaaattgcctcaataattgtatgagctattttaggaatcagagctaatgtgtgattaattagaggaccttgtccacatcagtcaggcaaggagcctccaaggagatgaagttattgaatcagtgtatctcctctaaggcagagaaacatgcattcttcttgtgatttcatgactcttaattggaatgagtaagagactagatattgctgagtcaaccttcaaggttcttggcatctccaatacaccattctccttgaaaacatttcagtatgttcaatgttgggcagttctaattgttagaatgttctgccttacatggtggtggcatctgcctctctttaacttcattcttaaaggaagggagggtcctagggtgatataatagatttcatcctcctgcccacagcagtcattgcagaatcttcagaattctatcacatttgtcccatattatggtccctggttcctctaccatccttgtttccctctgttaggggttgaatggtatcccccaaaaactatgttgaagccttaaccactgacctcagaaggtgattgtatgtggagatggggcttttaaagaggtaattaagcaggcctggtgtggtggctcctgcctgtaatcccagcactttaggaggccaaagcaggtggatcatgaggtcaggagtttgagaccagccgggccaacgtgataaaaccctgtctctactaaaaatacaaaaaattagccagatgtggtgcacacctgtaatcccatctgctcaggaggctgaggcaggagaatcacttgaacccgggaggcagaggttgcagtgagctgagatcgcaccattgcactccagcctgggtgaaagagcaagactctcacccggggggcgggggggggggtgcagtgggaaggaggtaattaagttaaaatgtggcctgtaagatgggccttcattaaatatgactgatatccttataagaagaggaaattaggacacacacacaaaggggaatgtgaacatacattgagaagacactttctacaaaccaaggagagaagcctcagaacaaaccaaccctgtggatactgcaaacttgaacttctaacctccagaaccatgaaaaaaaatatttctgttgtttaagccacctggcttatggtattttgttacagaagccctagcaaactagtatactcaccgccccatgagctatagcctcaactttcccctccttatcatgaggaccatgattgcaactgccttgtgggttgatggggaattccatgagatcatgcagtgtctgtcctggtatttagtgaaattgtcttcttgttaacattattctcactatcactcctatcatactacctgtgtttaagtgactaatgaaaacattaaatacaacaaagttaatactagcctaattttgtgttacttcagaatctgtaaggttgactttgacccattcctaaatacttcttcagaacagtcatgcttatggctcacatccttattaccaaaccttccttaccgaagctcatatttgttgcctctgacattctagtttactggcctcatactttaaaagtatgagagaaacaataaatatgtaaattattttgtttttaaatgcatagagttggtccaaatatgcaaacataaaaataggtctttaggtagtgacttggggtcataggtttactttctatgggctaaacatttttctgatggtaacaggatcattccataatattttgtaacaatttctgttttgggctttagtaatcattgagcaagttgcatgtgctatattgttaacattgtactctaggtgccccaaaatatgcaaatactctaaatctactgatttgaaatctggggtattgtgagtccggggtcttgctcccaccccctcctctcttgcagtttgtgttgccttggcaacagtcttccagcacatcacatcaggtggcctcttatagagacagcatcatgggctggacagcgtgccaggcttgtggccctggggcatccttgatagatgctatgggcgttattttctgcttataaaatcttagaacagttatgtctttacagataagatttgatttttatcaaacggtggaaaatgctgtgactggcacggtcttcacactctctcttggaaatctgcgatcctgggtcggtttaatttaaaacattccagtaataactttcagactttacaactcaattttattttgagaagtcatcatgaaggaaatatttaagaagtctcattcctttaagtttaaaaatgttccacaggattcatttgcaacagccagccactcaccccaaccccaaacttccagaaaaaattatgcctccaggacatttctccaaatgaagtgtcaagtccaaatcaagtcaaatttccaatgtggaataatggactctattttatgacctcctgcgccccggaggctcttcggagcccattacacagctggtgcatattaggtatagaaggaaagagacctgagtggctacgggtttctgctcggtgaagcccaagccacatttcataggttctgggattattaatggtatgtctagttgccttgagaatgttcaactccagtctgttatgaatacttaatagcaaggagaatgtgattcttctcttttcagagacgtttctgtgactcggcgaattcattctagtgtgataggcaaactgtcaaaattaatgaattccaactgagatttggttgtagtgcagttgtaaattagcattaataccacagtgtatgttgaatgtgctacattttcaccatggatctggcctagaggatgtctttggaggaagccactctaaaaatcatgttttctggtttggttttttcaatttttgatcatagttttaattctggaagaagtatatgaaagtaggtcattaagattttatagaacacaacaaaaaaagaaacaggaaataaatgttataaccaaagacatgttagcagagttgtcttgtttttgtgtggctgtgacttaaagatctgattactgaacctcaatctatctaaatgttaagtgattacaaaggaacacgattcagtttataaggctttagatgagctccaaggactacacggcatacctagcccaagcacatcttattatgagaattttaaataatctgcagcaatgtttagatcaaaggtgttttaagtggggatttggacctttaaggagctggaaacagaactgtgtgtgtcctttttgttcatgacagagtgcagcactttcttctcattcttaaagggttctgagcccaaacacagtcactgcttaactgacaacctagcaccaaatcccagctctgttcctcacgacagagttcaaagtttatatggtttctcatctctgacataaaaatagcagcaatagcagcctgtgaggtgtagtttgaggattaaaataaggttttgtatttagattacttagcataatcctagcacataatgtgtattccataaaagctaattatttaatcatgccaagaacagaagcaatagttacagctttgaatataaagtttgataatgcacttggtgatattttcttggcagacacggggctagcgacccatgtcagtggagattgaaatattgccacgtgtagatgcattaccactgagtgaaggagcacacttgggcatcttggtgctttgctgacacacaatacggaatccagggtaactaatttccttctcttctctagagctctgacttctcacctagtgcagtctgtaagaataaacatctataggattaaatgtgacaatgatgggtgaaaatgcttgggaagggcctaaggtgctgtgcaaatggagaggcggcattcagaatcatttgtagtgggctaggcatggtggctcatgcctgtaatcccagcactttgggaggctgaggcaggtggatcacctgaggtcaggagttcgagaccagcctggccaacatgataaaaccccgtctctactaaaaatacaaaaaattagccgggcgtggttgtaggtgcctgtaatcccagctactcaggaggctgaggcaggagatttgcttgaacccgggagacggaggttgcagtgagtcaagattgcaccactgccctccagcctgggcaacaagagcaaaagttgtctcaaaataaaaaaaaaaaagaatcatttatagtgaatgtttaattttaaaacactatatgtcactgagacttattgatatttaattgaatttagcctaacagtcttgtgttcaagaagtattaaatatttgttgagactctttgctacatgctagaaactattgtaggaattgggaatacatcagggaataaaatcaaccaaaatatttactttttagggaccaaaattttaggataggtttagaggcagacagttgaagcaagtataacaaataggtaaatgatcgagtgcactaaagacgctgagggccatggggagtaagtgcaggcgtgggtcggagggggcgctgcagtagtggaagtgccgccatctttaccaggcagtcaggggaagcatccctgagggggagacggcacagccaaggctggaaaaggtgagccagggagtttctgggagaaaaacatcccaggtggagggagagcaggtacagagacccagaggtgggagcctgcaggggtggtctagagacgacaaggaggccagtgtggctgcggtgggatccccaggggagggtggtaggagatgacatcagagaagaaacagtgaggatggatcctgtaggaagataggcttttacctggagaatggggtcctcaaaagctcagaacagaggccagagatggcctgagccatcttaactggatcactctcactgatggagctgatggatgagagtgtgtgtgtaggggaccagggtagaagcagagagacccattgggcaccagggagaggtgatggtggattggaccagggagtggcagaggagatggcacaaggcagatgcagggtatattttgagggtacagctaagagacttattgatgctgtgaatataagatatgaggaaaacagggacctctacaagcacccacatgtttgggttgggcaactgttaagaatgatgctttttacttcttcgattaaaactctcatattttaaggatatttttgagtataccttatgtgactcttattaatttttttctgaagtactaacaaatgtgcagaagaatcacatacatgaggaggaaggcaagaaaacttcttgaagttttaagaatactggatcccagaacaggggcatagctaagtggacaaggaaattaggacaataatttaaccagggttccaatcaacagattttttaaagtcttgcgtgtttgagactcctaaataagcctctgtaggcgagatttcagcatcgtgtgttttccatcattgagagcctgtggggcgtcattagtctccagctgactgatgtaggtgagaatgtcttattttgttttttgttgtttgtaacagaatgcctgacactggtattatagagaaatgatatattgatttcctccaattatggaggctaagaagtccaaggttgaagggccacatttggtgagggtctttttgctgatggggactcagagaagagggggctgggtatgccagctcagatctctcctcctcttcttataaagtcaccagtcccacttccatgacaacccacccactaatcaattaatccattactccatcaatccattcatggattgatctattcatgagggcagagcctacatgacccaataacctcttaaaggctctacccctcaatactgccacattggggattaaatttcaacatgagttcgagtgggggcaaacattcaaaccatagcagagaatcagacaaattgtgctgcgtccacttggaaggcactgttccgcatagggttggtttgggctccttctgatcatgattggaattagacaaactctctggaaacacactcacttacagactttgctttctgtgagtatttttttttttcctgttaaagctgactcttctatgttcagacccatatttttaagttatctttttacactgaaattcttaatctttcaagtttagatatggatttaccttgattttatggactgtgaatgccctcttttcttatctttttctattttatctatataatgatactaccatttggggttagatcaatatttatgatttacattattatgactatgtaaatattagctacagctgagccacatagtatatgatgaacactttttctattacagctttgtgtttttcctaggattaataatcacttgcttctttgtttacttagttttcactgcatgtgttactaattcattccccaaattctccaacggactaaacactcttcttaatacattcagatgcattagcgtgcttgaatgtttatttttttcctggaaacatctctccaggagccttctttctgctttaatctggactgatttctgctgtatgtttgttgttctgttatcgttcacagttattctggaaattctttttgtttctcacctatgttgtaccgtctgttttctggatatcgtatgttctttctgagtttgcaaccttttaattcattttttaattgctttttgaagaagggtacatgagaggtcaaaattttgactttgcatgatctaaaattgtcctcgtttacttgtttgatactttgagtatggaattctaggtcagtcacaccttgctttataaatggctgcacactgaggtccagaaaaggcaggcccttggtctccacactcctaggtcagaacctgagagcaggttccaactacagagaaccccagaaatgatggcaccttttctcacaaagaaatgctttttccacctccacagaggtctgccttcggttacatttaagtgttgattgcattgtccatacactcagtgctgtgtgagcacacggtttacaaggatgacaatgccccctttgctgcattcaaggtacaaatgttttggcaatgaataaagtcacatatacgaacagtctgttgatatgcaagggcaaaaatacagaactggatcaggtggtatgagtacaagggatggtaaagtcaggtgagtttcattcatgcagtattccccaatgtcctctgggaagatagaagagtacctcatacctggagcccggacgcaggtttttttttccatcactgctttggcgacagtaggcattgctgataagaaaaggcaactggacatctacactttgtcattgcttcctcatcctgccacagaagcttcattaacatggaaataaagggatttacaaacactctaaggacaaaggggaagagagatgagatgctggcagtcatgagatgccaatggcaatggatttaacattgtggagaaagccaaaagaagtcatactagaggaagccagtgagccagtctctcattcagagcaaaccctggaaaggctggtaaattcgagggaccagattagactggagtcaatccttaaagagtctttcaaagtttttttaaaaattgtcatcactcatgacttagggtgtatttgcatttatgagaatggtcatttattttgtttctgaaacttaaacctgtgcgttacatgaagaaagaaattacttaaaacattagatttctgtaagtccttaggtcagagcaaaatgaaaaatgaagcacttctgaacatagtgaagttctagcaaaagaaaataatgctcaacagtgtattagtcaatgaaactaagaagaatttatgtctttttgtcatttcacttcagtgttttcacttaatgctggagtgaaaggtttaattaccgaacttggattttacatttttatgctgaggtaccagtcagtctctggttataattcattttcttctttaatcataggagaaatgattcagttggctttggttaacgtcctcctccccttccctttgataatcttactttattgttgcttcactgtttttttgttgctatttcacattgccatgtttttggacattcaattttgtaattttttccctctctctccaactctttgcctcttaatctgcagaaagcaattctgttaacattattgtgatgttatctttatttctctgttatttctgctgattttcttcatttgtaattctttacataactctgtactctttcttcattcgtttgttctattcttgttccccagtttttatgcttccgaatcctaaggagccatttacatcattttggtttattcatgtgctttactgcctgtgatcataatgctcactgggtcttctgctccttccaaatcgctagccactttcatgccttttgaaacctttgagcttaaaatgtaaatgccggaacgtagtaaaccacatacatattattcattacagattctatattcctctctgaaaatgtacacttaacccctagcaatgttaatgagagtgactttaatccatccaaagggatggagagacttttatctctaaaatgaattccctatacacatatggaagtagtactctagaaatggattgcaaacaatactcagacattttctgggtaaaacactaatttatttttactttttttctccagagctttgtaaaacccatggcaaaaatcaggctttttccttcttgttgcaaaataagtacaaatattggataaaaagaacattcttacacaaagtagctaaaatcttcgaagtgtgttcttatagcacctcagaaattctttttgtcagccactcatccttgtggtcccttgatatctatataatggaatttagattatagtagatgatgtatataaaatacagattgttacttcttaaaaggaatctctttagttatatgtagtatgaaaaccataatatttttcttttaaacatttatttatgcattcaataaaaaatgtgagggcttctattatgtattagccagcacaccagctgcctctaagaataagattgcatcatctcctatgaagcatgctgcccctcttctagattgcaatggagtggggtgcacatgcaaaatagctatgaaaacattgatgacagtgtgatgcaagaagctgaaaggtaggacacggtgtctagtatgaaaggtagaagaccgggaataaattctaaggaattggtgtttagctgacattcaatgaatgagtaggagttaattggataaaggagggtgaagtgttccagctaagagcctagtaccagcacagaccccgagttggaaggggattggggacctaggacactgaggagaccagcgtggccagaccctagtgtatgacagctgtgagatgacattggattttttctactcacagtttcttaacctccaacattcaagaatgcaacctacatctcaacaaaaaacactgttacgttaccctaatggtaattagcactaaaaaaaaaaaaaaagagcgagagagacccagctctcagttctccttttggattttatatttttcactttaattccagcagatttgcttcatgtcctctgaagctcttttattaggtacatagacatttaggattgttatgtcaccttgatgaattgaccactttatcattagggaataaccatctgtccctagtaatatttcttattctaaaatctactttgatattaatataatcactcccactttctttagagtagtgttagcttatattttttctattttttttacttttggtctatcagtttctttataatagaatttctcctggatagcgtatagttaggtatttattttttattcaatctgacaatgttttacttttaagagtgtttaggcaatttatatttaatgtgatggtcaatttggtttcgtttaaacctatcatcttgctaattgctccctattttttctatctgtcctctgttcctttatttttctctttcttgccttcttttggattaatggagtattttttaaattgtcaattttacctgcattaaaggattaacatgtaagttttgtttttattttgctttgtaagtggttgcttttagagtttacaatgtccatcttcaaagtaacatggcttactttcaaataataccacttaatttatagaaggaccttacaacaataaatttttatttcctccttcctcctgcctttgtgttaatattgttattcattttatctatatgttacaaaccacacaatgcattattattgccttaacagtaatgtatcttttgatgatttaaagtgagaaaatatgattttatattcacccacatgcttaacatttttgtcactcttcatttctttatgaagtcacaaatttgcatctgatattatttcttttcttcctgaaagattttaacgatttttgtattgctagtctactgacaatgaattctcagctttggaatgtctagaaagttattttgtctttatgaaaatttttctgcatatagagctttaggttgacagtttttctttcctgtcttttttttaaaaaaatgcttcaaatttctctccccttgtcttctgttttgcgttgtttctgatgagaagtctgctgtcattcttatctttgtttctctaaatataacatgtatttattttttaatctggttgcctttaagtttttttctttatgttggatttgaacaatttaatcatgtgtcatgttgtggttttctacatgcttctgtttggtgtttgttgaatttgatggatagttgaggttctagtgttcattaaagtttgaaacttctgtatattaattgttcgattttttttctgtatctcattttcatcctagaactccaattatacgtatattaggccaaacgatattggcccacatctcaccagttttgtgtttactgtttttaagcctttttaaagtttgtttttcaatttgggtagttttaattgctctgttttctggttcattgacagtttcttctgaagggtgtaatctgccattaatcctatttgtctaactttcatttcatatattacattttgaatctctagaaggtccatttgactgttttatttgcagcttggctgtttgtattttctccatttctctcatcaatgagctcttcctttttcctactgtcttgtacatattgacagaatatttataagagtgatgttaatatccatgcttgcaaattgtatcatctctcatttatgtgtctttctgtggaatagtttactcctaataatatgccatatttcccttattgtgtccaattttttattgaatgacagacattgtaaattttatattattgattgattgttggtttctattaattatcatcaaagttttttgttgtgcagttcaattacttagactcagtttgttcccttctaggatcacttttaaattttgttatgattaatttgtcccctgcagctgtgtgatacatttctgaatactcaatctgatgttctatttattagaagttcttacctcttttgctggttgaaacatgaactattttctcccctgtgtgagcttcacagattttcacccacttctttctggtgttcctaatccaaccttggtagttttcttacacgcatgcaaatatcagcacacagttaaggactcatcaactggaagctccttccgctctctggagctccctctctatataacttccttctttccactttgtaaattctagcagccttagtcccctcaagtgtcatacttggtccccctaaccccacaatataaccaagttttattcaaatttcctccttttggaattatcttagaaactcaggaagtaagctgggccactcataaggtccactttgtttgtttccttctttcattttttttttttctgtactgtctgaaactttagtgaagacatagagtaaatccagttcttgtttctgtgtttttgtttgttgttttatgatggacagagacagaatttcatatttctaagtgatgacagttgcaacatcatttcacagcttgggagtagatagaatgagtgaaatatattaacgttaaaggcaaaattgctataacatatgagcacattttaataacctgacttggaatcacttcatagaagccttggaatgctttccaagtcattataagcccatcatttaactgatttgtgattgtctgatcgagatgacactgaatttctaagcatttatccaaagaaaaaaccattttggagtctcagaatcagctaaatgttatgctttctagatatgtttacctaaggctaagttatattccctttcattttggaagacctttacacaagcagttcattttagtaagcatacccactcacgtattcctatgaaatcaataaagctaacttgaacccaaatggcatttccattcaaaattaatgtacccaatttgcaaattcgatagcctgttttagttctcatgttttctgacctctctgaagcaattgacagtgttgaaaactgttggttaacgtctcaaaatgtctttttgtttctaagacatcactctctagggtttgagctactgatctcctaatttcctatttatctccttcatgatttttttccaatttctttaaactcttttaattttttaattgaaatgttacatacatgcaaatcactgtgtacacatgcagtgtgcccagcacccagatcaagaaaaagaacatagcctgcaccttggatgccacctcatggccctttccattctctgcacctgaccccacccccacgggcaaactttattctgactctcaacatcatagattagtttttcctattttgatgtttgatataaatggaacaatacagtgtaaatccctttggtgtctttttgcttttcttcaccattatagttgtgtgatttataatattttatgtgcagattgttcattgttatcagtatgtagtgattcaaggtgccaatatatcacgatgtatcaattttattattgatcgatatttggtaagttttcagtttgtgactgttacaacgtgttgctgctgtagatattccagcgtgtattttttgatggacatatgcatgtgcttttgttgtataaatacttaggagtgaaattgttgagtcacagtgtacacatgtgttccctttagtagaggctaataattttccacaataactactgatttacattactacctgcattgtttgagggtcttgttgctccacattcttaagaccctcaatatattctgtcttttccattgtagttattttggtggatgtgtagtagtaccccactgtacttttaatttactttttcttaatgaccagtggcattgaagcactttttaatgtgcttattggccatttatatattggcctttgtgaagtgactgttcacaccttgtgtgtgtgtgtgtgtgtttttcttctttggagacaaggtctcactgtgtcgctcaggctggagtgcagtggtgcgatctcggctcactgcaacttccaattctggggctcaagtgatcctcctacccctgcctcctgagtagctgggactacaggagcatgccaccacacccagctaatttttggtagagagagtcttgctatgttccccaggctgatcttgaattcctgggctcaagcgagccacacacctcggcctccaaaagtgctgggattacaggcatcagctactgcacccagcacttttgtccatttttgttggactatctttttatattggtgtgtaggagttcattatgtattttgggtacaaatcttttgtcagatattttcctaccttataaaatactccctatccctgaggatttacttctggtttttgtctcttcttgttctttacacttgatatgccttggctgtgccctcacccaaatctcatcttgaattcccacatgttttgggagggacccagtgggaggtaattgaatcgtgggggcaggtcattcccgtgctgttctcatgatagtaagtctcacgagatctgacggttgttagaagttttcctgcacaagttcactccctttacctgctgccaaccatgtaagacgtgacttgctcctccttgccttccaccaggattttgtggcttccctagccatgtggaactgtaagtccaattaaatacctttctcttgtaaattgcccagtcttgggtatgtctttattagcagtgtgaaaacaaactaatgcaacacttttcttggaatatctcacccagtgatagacttaaatttccctggctgccaaatatgtctctagggtcttggactcctatttccaatttgctattgggtggcccaggggcagtgccctctttacgttagtgaaactgacatgttgtttcctttaccaaccagctctgtcttgtaggctctctttgtaatagtgtaactgtgcaactgggtatgcaagcaattacatttgcctcctattgactttttttattttcttcactctttttgctcccacatccctgcccaccgatgctggtaggatcatatcagacatatccataattaggccttttttctcccttctcaccaccaatgcccagctggcctagactcccagcagagcagtctagccaggctttctgcctgcagtcttctctccctgtctactcagtgtttactttctcaaacttcaatttgggaaattgattgttcattgtcaaaactttcattgacttcctactttttaaaatagctttattcaaatataatttagataccataaaaagaatccacttaaagcatacagtttagtggtttttagtatattcacagataaggtgccttcaccacaatcaattttagcaggttttcatcacttcaaaagaaaccctcctatcctgtcccgttacccagtcctaaccataagtaagccactagtcgactttctgtctctacagatctccctcttctggacatttcatacgaatggagtcatacagtatgtggccttttgtggctgtaattgagggtcatccccattgtagcttgtgccagttcttcactctagtttattgctgagtgatatcccattgtaaggctaagccgcattttgcttacctgttcttcaggggatagacatgtaggctgtttccaccattggccattatacataatgctgctttaaacatttgctcacagttttgtgtggatgtatgttttcatttctcctgggtatgtgcctaattgtccttattgtctgcagggctaagcgcatgctttttagcttggcacctgacactctttacaatcttgactttataatcagcacccttccacgccttggttattagtgtgtctgctggtcttggcacagtgccagatacatggtaggtgctgaagagtgtttccaagataaatgaatctaagaaacctgtagctccctctcctaatcgtgcaacacttttagctgtgcattgaatttcctgcttcccagcacctttttatttctctcctgactgggacaactcaatgtcctaatattttttaagacttctgcctagaatgtacttttctttcctcctctggaaagttgtttccatttttcataggtcagattagtttctctatcacttatgcttctgttgcattttgtgaatgtttctgtcacaaccttcggtaaatagaattataattgacctcactatgtgaactagagtacccttcagactgaaatttccttggcagtagtaccaggacttgttatatcttgcattactgggcccttacacaagacctggtacctagtaggtgctcaataaatattattgcatcagtgaatgcttgtgtcactgcctactgcaaaattcctcccacatctccccttttcaccctgccctgtttgaattttaagaaaagctaaaatattgatttattttctttttggtgtaacactcttctttatgtttgtcagtggagccttggttatgccgtctgttacagggatgtaaaatattgagaagtctgcaactgaagaaacaattctccaaggtccctcccattagctcccttagtgttggtaccccaggattttcaaccctgaatttcacaagattgtgctgaatgtttcatttagctttctgttttgaacccacagttattttttaggaactttcacacacacacacacacacataattcacattaaggttgcctctgcccttactggaggaagcaaatgttactgtattaaagagcaggaggcactctataaaaagaagtgctattatttaggcagatggatggtcccttagatggaagaaacaaaagctgttggaatatagtttgggttttcttttgcctgtggccatatgatgtgtctcttagagaatgagtttatgttacattattaaaccctgtggcatgaaggagaaagactaatgtaaaattctttaaaaatataaggagaagtgacagtaatcccccataggtcgcttatctctttaactgctaggattaaacatttatttatcatttttttcctgcagtcatttaaataatttcacaagctggcttgtggaatgagattttcaataagaaactatacatttaattaagcaatgtttcttgtatacatttacatttttaaagtcttgctattcttaacaagactacttttaggatacaagaggataaattcaaatatgaccaaattttgcttagttcaaattacccacagtcgggttgatagaaaaataatgtagggaaaaaaaataaaagaatcctggtggaattaattagccttgaagagtgacagttacctcattcctaacaatatgtttggggtaatgtcagtttcttggaaagctcaaatgtaaaattacagtgctactatcagcatttttatttgagttgaaaactgccgtgttgaactattaactatgcttctgatctgaaccgatttcttagttagcaataattttcatattctgacttatgaagcattgctaaagactttagttatggttgggagagaaaactataaaacacttacgacttgatgaacacccctgcctctcttctctgtgggtaagagctatcgcttgtacaaaatgtatttttctctgccaccttttggcaattggtgttcactgtgcttcccagcttagccatagccccaactggccctggaggccaaactcttggtttctgccagtgatggagaccaagagaaaaacgatggatgtttcaagtaagatacctggaggatgctaaatctcatggacacagcttcccctagatctgactttccggaataaaggcaggcatataatgaaactaaaatagtgatgtgaaaaggtttcacctattctgtatgagtgtgaagagtgaaactttcgtgaattgttgtcttggttcattttctgctactaaaacagaatacacagactgagtaaattgtaaacaacagaagtttatttggctcatggctctggaggctgagaagtccaaggccatcaggtgaaggtcatcctaggtggaaggatggaagacagaagcaagtgttcaggatagaaagaaaatggaggcagaatgtattattttataaggagctcactcctgtgataatgacaataatccattcatgaaggatctgcctcttacgagtcaccttttaaagtttccacctcccagtaccattaccctggtgattaaatttcaacgtgagttttggcaggaacattcaaatcgtggtattctgccctggcctcctgaaacttctaacatacaaaatgcattcattgaatcccagtaccccaaaagtcttaagtaattccagcatcagtttgaaagtccaaagtctcatctgaatcagatatgagtgagactcaggcatgattcatctagaggcaaattccctccagccatgagctatgaatcaaagcaagctatctaattccaaaattcgatggtgagacaggaacaggatggacattcccattccaaaaaggagaaagaggcaggaagaggtaacaggtttcaagtaaatctaaaacccaacagagaaaacaaccttaagtttaaagctggataagaaacccctttaattccatgtccctcacctggggaacactggggtggggattgggtccccagggcctcaggaaaagctgccttggtggctttgttgggctcttgggctcagtttacccagcagctctcatgggttggagtcttatgtctgcagctctcccaggctgatgttatgtgctggtagctctacagttctgggatctcagggccagccccacttccgtggctccactaggcattactctagtggacagtctctgctgcagctctggcccattaattcgtctcagcaccgccctaatggggactctttgtgccggctccacctctaaaacaagtctctgcccagggccgcaggctttctgggaagtctttgaagtttaggtggagaaagccatgccccacagcttttgcattctgtgcacctgcagaattaacacaacatggatgccaccaaagtttatgattagtaccttccagagcagtaagttaagccaggcctgggaccacttgagccatggctggggcagctgaggaatactttgtcacaatgcagcggataggtcccgagacagcttgggtagcaagccacggagagtgcccaggcctagttattagctcatctagttattagattaatgtctcttctgcctctattctgctccctacttcttcctttattgtgacaatctaaagttggtgcttagtgtttaaatgactggttacatgaccatttagtttcttaacaagatgtagtgctaaaatgcatgagctcattccaccataccaaatcttgaccaccatatgccatcctcataactttctaacagttcttcctaatgaagttttctttctaggctatagtaggccaggaatctcattacacttgcccttcctcatccccacaccaacatatttattgatatatttcctaaccttagttaaagaatgaagttttgccatgtgcactctaaggtatatttgtgcaaggaaagacagcaatccttcccatctctccttagtgaggttaggggttaaccttcttggttttactaaatagaagtctacattccatataggcacacgagagcaagtttcctaatgtaactgtgacacaacacacgtctcaatgccctgcaggattgtgtgtcattgaccactgtgtttatactgataaacttttctataattgaagcctttggccctggtaacatttccatcctatatgacaccagtgaaaagttagagttttcattggtgccatatatggcctaacagccagagtgaccctcagatctcaccccagtagtggacctgtcaggtagatatcatctgccaacatccccaaggaggtgtaggtcttcaagtgtgagatcatccatgttatttccagcattgttgaacaagacacttcttgagacgcacagattgacaatagcttttgatgcttcccctgatcaaggagaaagagggtcttatcgggggcccatctactttggagacatctacattgtgtgtccctcacaggggagcagaattcacatcagtatgtaggctttcctgttcatagtggaaggggggccacagtttgtaagcatctctctatatcaggacctcgctaaaggctttcgcctgtaccccccaccttctctctctctctctctctctctctgtctcaacttctatacagtcagttcctaaactgtgagaggtaattccaatctacttaaaagagttgtaattttgtaaaatagaaattccaaaaatacttcaaaaggttacattatattatcaacagaagtttgacataccacatgaattatgagatgggaaaatgaaaaaatatggggacagtgaatgcaccaactagcatttacgaaacacacacagcttgctaggcattaggcttagggctatgagcccattgaatatgtgaagtttaactaaaaatcaaaatgtttatataatagataaatgttagattctttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgaaatgttagattcttacatgagtatgttttcataaaacaaactacacactgtcactgtccagattcaatgggttcccaaaaacataacagcctgagagtcttagttgtgtcattgccttattcaatgtaataattattgcttgtaaaaatgttttaatccagtgataatccagatttagtactttcttccatcttggtgtattttatttattgctcatgctctattggggagcttacatgggatgttagttggcactttctgattactttatttaaaatagaaaaacatttcagaaagacatggttgtagagggtaactagcagagcctcatttgatgtctcctgttgagttacctgaagggagatgctcagaggaagagttgcatgcagaaggcctcctgggagtgtattctcaagagagacatcagcaagggtgtgaggaaggcagaatgagtggagggagaagcttctctgcaaagctctgatgatagcggtctcaggtgggatgcaccttcagcattgttgcaacttaacacgagggggccaggcttgtggagccacctttgaccagtcattccctgcaggcctcagacaaggcagttccctgtaacttgggctggttcccagtgtaggactcaacataggatctttccagctgctttggggcagggtgcattggcgctaaagaggaaatctgaagggagccccacagtgtccaccaagtggcagcagggaagaacatgctgtgagtagagtcaaccacatctattcagccttgtgccaatgcttggatgctgtgcttcctaacagcagggtggagaccacccgctaccctcacatttagtgagcaggttaaatcttattattataagatgagtccaatcacctttgtaaatagtgttaatttcttcatctctttcttaccaaatcatgtcagttaactacaggcaaagtgaggggctcatgtattttatcacatagacttagtagcaaccccagcacatagcaggagcctgtaacccctcagctccacaccacggagaaagactagatctggaagcacaggccatagacccactctatacagagctgcctgtaatccccacacaaatgaggggggactgttatgccacatttggttctaagatgagaaaacaaaaatctcaaaagccttcatcagaaagactgaatctagttctgccacctcctagccctgcgttcttgctcaagtgacagcctgtatcctgtgtccttggtcaagtgacagccctgtgaatctccatgtcaccgtctgcaaagtggagcctttgtttacctagcggagctgttgttcatctcgagtgttagaaggttgtctggtatgagatactatgaagcatacaataaatgttattctcacttctgaccagtgaagttcattcgaaatatctggggcttctcttctctcttacaaatatgtaactaggtatgcacctgctttagaaagtcatggagaagctcagatgtgtgacaagtaggccttcattatatttataaatcttttatttaacttgtaaattctggaagtcacgttttatttcttcacataaccaacactccagaaacacttgttataggcccttaaatgaattaaaaagccaaatgtgtatgaacacatttgatgatatttacttgtagaagcgaaaagagaaacaatttaaatgaaaagagcagaaaaacagttcataagaatatgtataaattgtgcattcactgatatttacttgtgaagtccgtatagaaccatggaataatgtagatgatgtataaaagaattaaacagttataaaaatggtacattttacgtatgtacactttaacatgatataattatatagataaggcatggaggcaggtggaccacaagggaaatgtaaaaatcaaaacagacactgtaggctggtggagttgagtcatgcttttgtcaaaattctctttattgttatgtcctattttaaataaaagtgtattgttgatttgacattgtattttctgataatggtgcttttttaacatgctttactctacaaagaacttaaatttacaagaaaaaaaaccccatcaaaaagtgggcaaatgatataaacagactcttctcaaaagaagacatttatgcagccaacaaacgtgaaaaaaagctcatcatcactggtattagagaaatgcaaatcaaagccacaatgagataccatctcatgccagttagaatggtgaccattaaaaagtcaggaaacaacagatgctggagaggatgtggagaaataggaacgctttaacactgttggtgggagtgtaaattagttcaaccattgtggaagacagtgtggagattcctcaaggatctagaaccagaaataccagttgacccagcaatcccattactgggtatacacccaaaagattataaattattgtactataaagacacatgcacacatatgtttattgtggcactattcacaatagcaaagacttggaaccaacccaaatgcccatcaatgatagactggataaagaaaatgtggcacatacacaccatggaatactatgcagccataaaaaacgatgagttcatatcctttgcagggatgtagatgaagctggaaaccatcattctcaacaaactaacacaggaacagaaaagcaaacaccgcgtgttctcactcataagtgggagttgaacaatgagaacacgtggacacagggaggggaacatcacacaccggggcctgttggggttggggaactaggggagggatagcattaggagaaatacctaatgtagatgacgggttgatgggtgcagcaaaccaccacggcacgtgtatacctatgtgacaaacctgcacattctgcacatgtatcccagaacttaaagtataataaaaaataaaatgttttacatatgatttgcaattttaattaaaaatgtggcaaatttcattgcataataaccctcagtgaagctagtaaagagagcaatttgatcccagcaacaagatctaggcattcacacattcagcttccctttactgagagtccagtgagagctgggctctatgctccaggtaatagtgggagtaaattaagaccttgtcctcatgaggcttatctctagtggcagaagatagacaataagtgaatataaaatatatacagtccaatggtggtcagtgtggggagagaacagggtttggggcatgaggcaaaaaaacaatctattaaaaattaacatccaggataacttaacagtttgtgtacaaaatgtgaaattaggatggtgccttattttttagtatcagcctgtctgctcacagcattttcagaaaatttgaattatttggttttatttgagcctgcgcctcatgattaattttcaggataactttctgaggccagacattgaactgcaaatgtcaaaggcatgttttactcacctatggatccctgtgttgtcttcttgcagttttcagtgaagacctacactccagcctctactttgtcaatgcatctctgcaagaggtagtgtttgccagcaccacggggactctggtgccctgccccgcagcaggcatccctcctgtgactctcagatggtacctagccacgggcgaggagatctacgatgtccccgggatccgccacgtccaccccaacggcactctccaaattttccccttccctccttcaagcttcagtaccttaatccatgataatacttattattgcacagctgaaaatccttcagggaaaattagaagtcaggatgtccacatcaaggctggtgagtacagctctgggctttgttttttctgtgcctgcttgggatgggaggataatgacaatgacacatagcaaaatgccatcacagcagagaaccaatgaaaaccccatcatcagttcattctgaccttgctgatgacttctttaaggtctccttgtttagatttcaaagtgccttacattgttggaactaaaccttgaaagaaagcagtgattagcaagttggcaagttctaacatcccagcctccttatattttgtctaatttgatactctaattcaaattttcagtgtctcaaacccaatgtgtttgcttccacccctccttttttcccacttgcccttcccctaccccatcctaggggaggagaaagagagagaaaaaaatgacaaatggttgagctggaataaaaccatagcatcaagatgtactgttatggaaacagaatcaatctaatatccttgctttccttgtgaaatagaaaggctattttaacatttttgactgtatcacatgttgctgaaatgttgtcagtacataaatcctgaatgggctatgttccttttaacaacatattgtgtctttttttaatcaccattgctacaagtcaacccaggaaagaatactgcctgagatacacagacatcaagggctatatatacaggacagattgtgtggttctatagatttaacaaagccctgcaaaacaaactcacagctagactcctgttagcaaacagcattttaatttttttaagtctagctctgaaatacttgtgtagactgacataatataatagcagggcaaagagaatgtgactttgatttttttcttatacaccaggtagctgggggagctttgcaataatttcttcagtaagtgagtaggtgctggtagaagacatcacaacatgagaaaaatatgaggtgtttctgaattcctgcatatgatctctttgatgtaagccatcaaacattagactatgactcatgctgctagctagtcattttcccaactatattttgatctttgtgacatgctcatgaattccaagacctgcatgagaattcacataagaaagaaaaaaaggattgtctttaatcaagatatatgaaaatttgatgtgtcaaataattacaatgcaatttgtatagggacctctaaacctgacaaacagggagatacagtgaatgacttttactgggaagactgcacattttaatgatgtgttataaaagcgtatttataatctgcaaaacaccacttatagggaaacctagaatttcaaacagctccatctgtgcgtattaatccattatgtctgccttggattttctgtcagataaaggaatgaaatgcttactcctgttttaactatcatcttctaaattagtcatagaattcattgtttttgcatgacactgaaagttttagagcatggacattgcatcatcttgtctggcgtctgtgctacctgcctcttcctacccagttgtgcttttactatttatgtgctggcgttcttgacatctgaaaccctatggactatgaatccagcatatggatgactactgtatcagtttgaacatataagatgggcagtcatattacccaaatcaaatttctctcctgatttcattttgctttttattgtgaacacataatggttataataatcttttaggttgttcactggatacttgaaaatcttttttcatcctgtttatgtaaatatgagtacagaactggaagcttgttcaaaaagacagatgaagggcataaatgctaccctttgacagctgaagggtaggtttgagggtgatgactgctcactcacggggtatcctcttctgtatcaggtcatcctaaatgtctaaatatccctgtagattggtgtttggattttcctggaataagctattaggtagaatgacttcataatctttcccttggcagcacaagggattctcattcttaaatttcagaaattttgacctaggtctgggtgctagcaattgaaggaaggtttactcatcatgtctcattaatcatcaatcctagtcctaacataagatattttcttgcctgttctaagggctggaatgcaggtgggccacttcagacagtattgctccttacccaggctgcctttgctacagagcaagtagcaatgagccgcctgatcctgggcaagtcagaagatttctcatgattgttttctccttagcagactgtgctttctttctttctttctttcttttttttttttttttgagactggagtctcgctctgtttcccaggctggagtgcagtcgcgcgatctcggctcactgcaagctccacctcccgggttcacgccgttttcctgcccagcctccagagtagctgggactacaggcacccgccaccacacccagctaacttttttgtattttcagtagagatggggtttcaccgtgttagccaggatggtctccatctcctgacctcgtgatctgcccacctcggcctcccaaagtgctgggattacaggcatgagcgaccccggccacaaactgctttctaacatttgactaggacttttgcttgtggccgagatggaggtgtgggagccacatttacccttttatctgaaacaaccaaaaaccagtgtcctgaggctgatagggtttaactctatgtccgcacccaaatctcatcttgaatgataatccccataatccccatgggtcctgggagggacccagtggaaggtcattgaatcatggggtaagtttcccccattctgttctcgtgagagtgagtgagtctcacgagatctgatggttttataagcatctggcacttccgttgcttgcattcattctctctcctgccaccctgtgaagaggtgccttatgccatgattgtacgtttcctgaggcctccccaggcagttgaaactgtgagttaattaaacctcttttctttataaattgcccagtcttgggtatttcttcatagcagtgtgagaatggactaatacaaccaactgaaaaaaaacaacgaaaaatgcagacaaaatatctgaagcaaccattttcaagactggacctcaggcagtagaggaaagcattccttaaggagctggaaataagatgtgtcctatgcttgccttatgctttgggataaagaatatcaaaatctgcacataaatttgtatagcaactttattcctaattgccaaaacatggaagcaacaaagatgttgtttagtatgtgagtggatggggataaagaatctctccttgactaactttggaaaggctcctctgagccctcctctcaactagttctcaaccttagcttttcacatctggtctcttgtccccagctttagcaagaatcctgctaaatcatccccttactcttgatacttgatcactcttaatatctgatcaagttcttccagtcccatctttgatgtatacatgtttggcctgattttagcaagaatctgttaggccagtttagcaagaatcctcatcccttgatgtctcctctttctaattttccacccactgctcccctcactgtgttcattggctataaaccctcacttatccttgttgaatatgaagttgaattacccttccctgttgcagtcatcatagatgactcctactggaacagacatgaatataatcttatctttttaataagtgttagaacatttttttctgttctttaatatttttgagaggacatctccctctcttgtccaggtcggagtgcagtgatgggatcgtggctcactgcagcctcaacttctgggctcaggtgattcccctcagcctcccaagtagctgcggctacaggcataagtcaccacacctggctaattctttaaaaaaaaaaattttgtagagggtattctcactatgttacccaggccggtctcaaatttctgggctcaagccatctgcctgcctcagcttcccaaagtgttgggattacaggaatgagccacagggcccagctacaatttttctttaacattagacaaattatagtataaaatgaagtattagtcagcgatagaaaaaatgtgctatcaagctatgaaaagatatgggggaaatttaaatgcctgttactaagtgaaagaagccagtctggaaaagcaacatagtatacccttccacctacttgacattctggaagagataaactagagagacagtagaaagatcagtagtttccaggggatagtcaggagggagggagggttgaacagacggagcacaggggatttttttagggcagtgaaactgttctgtatgatactgtaatggtgatacctgccattatgcatagaacttacaacatagagtgaaacttagtgtgaactatggactttagttaataataataatgtataaatatgagtttattgtcacaaatgtatcacattaatgcaagatgataataatgaaagaaattaaaggatgtggcaagagggagaatatgggaacctgctgtgaacttttctctaaacctacaactgctctaaaaaaaaatcaagctttattcaaaaaaattaaaacatgcttcaggaagcttaatgacaaattaagccccaagggaagggatggtgaaatttaaaaagaagtggaaaaatgcaggccaaaattttccaaatttgttgaaaactataaacccacagatccaaggagctcaacaaaccccaagctcaagacacgtgaagaaaaaatgcacaaaggcacatcataatataataaaattgctcagcgcaataataaaatatcaaaagcagctacagaagaaaggcatattacacacaaaggaacaaagataagaatgacagtagacaggatttttgttgttgctgttgggtgtgtgtgtgtgtggatgtgtgtatatgtgtgttttatgagacagggccttgctctgtcaaccaggctggggtgcagtggggtgatcatcgctcactgcagcctcagcttccctggctcaagtgatcctcccatctcagcctcccaagtagctgggaccagaggtgcatgccgccacatcaggctgatttttatttttatttttgtagagatggaatctcgctatgttgcccaggatggtcgctaactcctgggctcaagaagttgccctgccttggcctcccaaagtgctaggattacaggcaagagtggaagtaaatttataaaataatggtgagatgaaggctttctcagacacaaaatagcagaaaatttatcatcagctgaatcctactacaagaaatcttaaaggaagttctagaatcagaagaaaaaaatgacacctgatcaaatcttagatctactcaaaggaaagaactgcaatgaaaatggtaactacatgagtatctaaatcagattttttaaaaaattgcaatattttaaaaaataattggctatttagacaaaaatagtaacaatgtcttaggtagtttgtaacataggcagaagtaaaacttatagcaacaatagcattaaggcctacagtgaagacatgggagtgtaatattggaggttattttgctatatgtgaagttgtgtaatgtcacctgaatatagatggtgataagttacaaatgtatactacaaaacctaaagcaacctctaaaataacaaaacagagttatagctaataagcccacaaaggagaaaaaatagaatcattaaaaaatcctcaatccaaaacaaagaagaaaatgataagaaaaaggaaacacggtaaaaaaaaaatacatatcaaatagcaaaatgataaacctaaccgtatcaatatccacattaaatttaaatgttccagtaacctgaattataaggcagaaattgccagattggatttaacactgcttaaaagaaacattctttaaatacaaaggcacaaatagcttaaaagtaaaaggataaaaatgatataccatcctcatcaaatcaaatcaacctaattaaagtaaaccactgaaagaaagctagaatagccacattaatattaagcaaagtgtatttccaaacaaatacactgtttgctcagagcatcttgcattagtgtgatacatttgtgacaataagctcgtatttatacattattattaactgaagtccatagttcacattaaatttcactctatgttgtaagttgtatgcataatggcaggtatcaccattacagtatcataaagaacagtttcactgccctaaaaatcccctgtgctcagagctaaagcagttcatttcataatgtaaaggggggaggtgaagaggatatgactattgtaaatgtttatgtacccaacaacaaaacttcaaaatacataaagtaaaaatggatagaactgcaatgagaatcagacatatcaaaaattatagccggagatttcaatactcctagttcaataattggtagaagtagacagaaaatcagtaagaacaaaaaaacacgtgaatgacactatcaatcaatttgatgtaattgacctttaaataaagaacattctatccaacaacagcacaatataaattctcttctgagacacacagacatttactaatatagaccatactcagagcaacaaaacaaatctcagataaatttgttttaaattcaagttgtataaaatatgttgtttgatcataatgaaattaaatcactaacaataacatctctgagaaataaccaagtacctgaatactgaatagcactcttttaaatgatctgtgtcaaaaaaaaaaattcagaaaaaaatttgaagaaggaaattagaaagttttttcaactgaataagaaatgaacacacaatatatatgaatttggggagtgccactaaaaaaatagggagattttattgctctaaaaaacttatattagaaatttttaaaaaagtcttaaatagtggtctcagcatccattttaaactgaaaaagaggataaaactaaaactataagcagaaagcaaacaatgaagatcagaatggagatcaataaattatagaacagaaagaaacaatagaggaaatctatgaaactaaaagttcttttaaaaaaattgttaaaattggtgtgtttttcaccagaaaagtgagagagttggtaaatgactaataccaagaatgagggagataacgtcactttatcttctacaggtattaaaatgatactaagagaacattaagaaaagtagatgaaataaaatattttttgagaaacacaaactatcaagactcactcaaggaaaaacagataaactgaatagccctatatctattaaagaatttaaatttattggtaaaaattctctacagtaaaattcctggctcaaatggcttcactattgaattctactaatcctttaagaaagaaataataattttggccaggcacagtggctcatgcctgtaatcccagcacttttgggagaccaaggcaggagaatcacttgaagtcaggagttcaagaccagcccggccaacatggtgaaaatccatctctactagaaacacaaaaatcagtcaagtgtggtgacacatgcctttagtcccagctacttgggagactgagacaggagaattgcttgaacccaggaggcgaaggttacagtaagccaagattgtgccactgcattccagcctgtgtgacagagtgagggagactccatctcaaaaaaaaaaaaaaagaaagaaagaaagaataaaaattataaacaaattcttccagaaaattgaggagagagtatttcccaaatcattttatgaagttagcattaccctaatacataaacaagacataagaaaactaaagacaagtatctcttctgactatacatgtaaaaattctaaaaatttaacaaattgaatccaacaacatataaaaggaataatacattatgaccacaaaggcttatattcataatgcaaggtgagtttcacatttgaaaattaatcagtgtaaaccatgtgatcatttcaacagacacagaaaaacattgatgaaacccaacatccactaatgattaaaagaactctcagaaaaccatcagtagaaaggaacttcctcaatctgataaaaagcaactacgaaaatcctgctatagcgaacatcatacttgtcaaagatgaaatgttttcacccccaaatgaagaacaatatcaaagtgtatgctctcaccacttctattctacatcgtcctggaggttctatcctgtgcaacatgacatgctataagaagatgtgctgtgacccagaccttcttgttttatttctagagcataggcaaagtagatttgtcataattaattctaagaaataattttagaattattgaaatggtaaatgagcattgacttcatcttagtcatcagctgcattaacccttaacaagaatcagcttgttttttgaagcattgaggctaggcattgacttctcctctctagctatgaaaatcctggatggcattttcttttaatagaaggatatcttctgtacattgaaaatatattgtttagggcagccaccttcatcattgacattagctggagcttctagataacctgctgcagtttctccatcaacacttgctgcttcaccatgcatttgtatgttataaagattgcttctttctttaaatctcagtagccaacctctgctagcttccagtgtttcttctgcagctttcccacccctctaagcctccctggaattgaagagagctaaggacttagtttgatttaggctttcgcttaaggcaatgttgtggctagtttaatcatctctccagatcttctatctactcaaattttctccacaccaccagtaaggtagtttcactttcttatcatttgttcgctgaagtagcacttttcatttccttcaagaacttttcctatgcatttacaactcggctaaatgcacaaaaggcctagctttcagcctgtcttagcttttgatatgccttcatcactaagtttaatcatttctagattttgatttaaagtaagagatatgagaccatttctttcacatgaatacttaaagaccactgtagggttatttattgatttaatttcagtattgttgtgtctcaaaaaaagggatgcttcaggagagggagaaagacggaaaatggcatgtcagtgaggtgggcagagcacatatgacctgtattgattaagtttgctatcttctgtaaatgtggtttgtggctccgcaaaacaattacaatagtaatatcaaagatcactgatcaatgatcaccgtaacagatataatgattttaaaagtttgaaatattgtaagcattaccaaaatgtgacacagagacacaaagtgagttcatgctgctggaaaaatggtgctgatagagttgcatgatgcagggtttccacaaatcttcaacttgtaaaaaacataatctctccgaagtacaataaaatgagtatttcatgtgagaaacgcacatacagccatccagatgcaaagaatggactcagagacacgaagaacagcagaagcgactctttttttttttttttttttttttttaagacggattctcgctctgtcgcccaggctggagtgcattggcgcaatctcagctcactgcaacctctgcctcccgggttcaagtgattctcctgcctcagccgcactagtagctgggattacaggcatgcgccaccacgcctggctaatttttgtatttttagtaaaaatggggtttcaccatgttggccaggctggtcttgaactcctgacctcaggtgatctgcccacctcggcctcacaaagtgctgggattacagatgtgagccactgcacccagcctaagcaagacttttgatgcaagatcaggcgcctgttaggcaggcacacccagggcaggtagagcaggtaatttattgcctagcaagcaagtccctcccccagttcctcattgattgagtactatggagttacaatcttcctggacatcgcctaagtttcattatcccccttttaaagttataacccaatccccttccccacttaagttttgatttcccagtaacaaaactttcttcccttttatgggctgacccctcgtctacattctgtttgcttatcgtgaccttctaggtgcatgagccatgcaatttgttacatctgcaggctggctgccagtgcttagatttattatgccttgaaaatggaccatttaaaatgttttctcacattcgctgctgtcaatgtagaccaaccgtgtgatctcttgctcaataaataagccatgtgtgtgtaatcaaagtaaagttgatttcagttttaaataacttcttataactataagatgcttttcgtaagcttcatggtaaccacaaagtaaaaacctatagtagatatgctaaaaatataaagaagtatgaaagaaattgaagaggacacacacacacaaaatggaaagttatttcatgctcgttgattggaagaattaatagtgttaaaatatctatactactcaaagtgatctacagattcaaggccatccctaccaatgacattcttcacagaaatagaaaaaaaaatccttaactttgtatgaaaccacaaaagactccgaaatgctaaagcaatcctgagcaaaaagaacaaagctgtaggtatcacacagtctaatttcaaagaatacaacacaggtgtagtactggcatactatagcatagtactgacataaaacagacacatagaccaatgggatagaatagagaatccaaatataagtccatgcgcttatacccaaatcatttttgacaaaggtaccatgaacacacattcaggaaagggcaagctctttaaaaattagtgttggcaaaactgggtatctatatgcaaaagaatgaaactagatccctgtctttaactgtgtatgaaaatcaactcaaagtgggcaaaatacttaaactaagtcttgaaactatgaaattactgaaagaaaacactagggaaacactatagaaaattagtctgggcaaagatttttggggtaaggcctcaaaagcacaggcaacaaaagcaaaaatagacaaataggattacatcaagcagaaaaactctgcacagcaaagaaaataaaaatcagcaaagttgaagagacaacatgcagaatggggagactattaatatttgcaaactctccatccaacaagaatataatgatggatgaaactggaggttgctatgctaagtgaattaagccaggctcagacagacacacattacatgttttcactcacatatgggatctggaaaagtggatcttatggaggtggagagtggaatggtggataccagaggctgggaagcaaggggatgaggagaggggttaaagagtagttggctgaggggtataaaaatacagttaaatagaaggaatatgttctaacatttgctggcacagtagggaaattatagttaataatttattgtatatttttaaattgctagaagaaaaaagatttactgtgctcccaacacagggaaaagattgaagtgattgatattccaattaccctgattttatgattatacattttatacaggtatgaaaacatcacatgtaccccagaatatgtacaactcttatatcacaatgaaaatatttgattaaaaaaataaataggcctgattttgtttcaaagtcatattaccagagatttttttttcttctgatctaaaaagatgacagattttactgaatgaaggctaaaatgattgcagtggaccctactggcatccctgaatcagatcccccaagatctgcgcgctggttgctaagaacatgaacctgcagccttcagaggattgcttgggcactggaaccattcacagaaacaagagtgggaaatgcctgggagttccatcctcctgaggccagccctaagccaatgacagacagctacaacaggggatcccagctcctctgcatgaccgagcatgtcaggtgtggctgggacttcacctgaaaccacacacctgctttgctgcttccctccctgccctactcacactttccctgcctctcaggggattgtgtccttgctcagtcgcttgaacccagctcctccttttggggtcgaataaggagaagggatggggagtgtgcagttttcttctgatccccgttctctctgagcgagctggggttcagagcaccacagtgctgtccctgctttgagaagatctgggctctctggggagagcctaacttatgacaccaagcacagtacttagataatactctgtcttataatgcaaatgtcaatcaaatttaaaacaaagtgtatttttttttttgcctgcatctcaggtttctagcccagtgtctgttactgcaacaaagttagcagtagttggatgtagaatgaagatcaaggctgcacccctgtcttcggggctgactatgggctcaggaaactcacatggccctctgagagatatatcgccatagacagcaatgttggtgtcttaagttatggaggcctcaggaacaaacaatgctctattacaaagattaggagctttaataaaaccctgatttgcatttttttaaaaaactatagatagtggctataaattcaaatgtgcatacatgtatattctgtaaaaggattagaagttctcccagaatggaagctctgtctttctatatattcagtctcaaaatatgtattgaacacctcttgtgtgccaagtattttctaagataattttttaaaggctcactgcacaggctatctttgtggaatgagtaatcgaataaggagaagggatggggagtgtgcagttttcttctgatccccattccctttgagcgagctggggttcagatcaccacagtgctgtccctgctttgagaagatctgggcttcttgggactgacctggaggttggagaagcaaaagtcacacaggtttaaaattgtgactactaaggtgtcctggtactggtgagggcagtgggtagctagagaggagaaaactccatgatatgtgggtaagtgctgggactgaggggtttcctaggacactggacattgggtggtaacactgggaatgtccccggtcagtcaccccatatttttatggctcctgtgatcccatctagtgtaggctgtacacctggtgggaaggcatttcccgtgtctcccggtaaacaggtgaacatcttttcttctcactttcctgtctgatacatggaacttgacccctttccttgatttctattaaaaattatcctacttgagtcattaatgtttgaagcagagtctgcggaaggtttggggagacagagtgattttattgcaaagaaacaagcatcacacagacaaaggagcttaaattgaaatcattcccctgcttaggggcactattcctgtgacggtagactctctctgttgaccagtccctctttctcctctgtcctccatcctcctcttctcctctctgtcttctgcttctcaccatgcccagattctcaccaatgagtttgattagtttgcctatatcttcatagtctttttctaatctattaccgtagacctcagctcccagcaaaggtttacttatgcaggagcctttctgtacaaagtcagttccctcctctcggtgtaaggatgttgttgctgaggtcagtctcttgggcgccctgaatttttgcctagtggacctcctgcaggaggtgtggagttgctgcctggaccttcacctcatgccgcttggggattacagtgatgggggtcgcagaagatttcaatacttggaaaaatctctctggttagatacaataatgaagaaattctccaagttggggaaaaacggctaatgttaaaaatggaaactggagaggaaggctttcatgaaagacatgctttactacaaaaatgctcagcatatcacaaggttagcccgaccttaacagtcctcttctaaagagctcacctctgcctactgggagatttcccttgagaaattcacctttagctttgttggtgtgttagtaccttttgaaaccattttcatggcacatatttgtccagtaagtgattaattctttaagtgaggtggttagatgattagacaataagttatctctgtgggtatcttagaaaatcatagacttataagatttagaccttgaagaggttcccaccacaatgccctcattttaaatttgaggaaaacaaagctctaaagaagtaaggctggcacatctaattgggactatattcatcagtgtcttacttccctggagacagatcttccccaaccctggggatccatctctggctattggtaagtgtggccttacccaacctgcttctagcagacactgttgaattttcacctacgttaactgattcaccacagtcaccctagggggcagatgctaccaacatcatccccatggtatagatggtgagaggatttgctcactgccccacagtcagggagtggccgagcttggatttgaacccagggagttgggcctgctaggtaggttctgaacaccagtaccaccctgcctctgagcctagacatcaaggacgtggaagtccactctgcagtctttctgggatgctcctatcattggagtgtttgggcaggctgtctaatcaacatccttccctaaacaatgggaagcaggatcagtgtttcccaaactgctttgcaactgtcatttaaaaatttactaatgaaaaattattttaattgtctcagagttctcaaggcttcccagaaaaattgccttgcctgaattttttattcattttttgcagtcagaaaaaaaaatcttcctcggcccttagaggactaatagcagtttgccatcatcataactttgcagagccagtaacttttctttcatgaagctatttcctatctcatgataccttcagggggtctattaactattttcgattatactctggccccttggtatagagtgtagtgtatttttttttcttcacccaggctgggtgcagtgatatgattatagctcactgcagcctcaacctcccaggctcaggtaatctcatctcagcctcccaagtagctgggactacaatcacacaccaccatgcccagcaatttttttgtatttttagtagagatggggtgttgccatgttgcccagtctggtcttgaactcctgggcacaagggatctacccatcttggcctcccaaagtggtgggattacaggcatgagccaccttacccagctatgtattgttaagggaatgaatgttttcttaagtcaggcgatgaaagacgtgaaatgtaggcatcttaactgttttccagaaagatatgttatgcaattgatgtgtgtgtgctgcagtgtatatattacagtgagatactctcagaatgagcctgttgaccgtgtgccttactgacgtcctctttctgccttccagttttacgggagccctatacagtccgtgtggaggaccagaaaaccatgagaggcaatgttgcggtcttcaagtgcattatcccctcctcggtggaggcgtacatcactgtcgtctcatgggagaaagacactgtttcacttgtctcaggtaggctttgcgtctccagggtgcaggacaccacgctcaccttctgaaaaggttatttcagagatggaatcgggtctccgtttatgtgttcatcataattcagaattagtattcttaaggctgatgctattttgtaagtaaacctgaaataagtgttttgtattggcttataatggcttgattcagacatcctttggtgggttgactgatgaagagagattagttaccggcactgtaactgtagccattgtgttaacttttttgagaaaattgtggttttacgtctgcttctaaaaacaaggtagtagtattttgcatctgtgagagacctcagcattgcatatatagctgacattctgaaactaaaatctggaaaatggaagccctgttttcatgaccttttggtgctttccaatgtcttgagagttatgttgtatctctgacctatttcttgaagattctactaagaatatatatgtagcaatgaaatgtatatttgcatatgaataatttcttggcttatatttggtgtgtagaaaagacaaaatttaaatttagcctccaagaaactgcagttcttcatttctaatggtgttgatttcttgctctgtgctatttacctggaaaggcgactgtccgcgtgatgcatggtgctcctgttcttacatccttggataatgactgttggcatatctcaaaatgtgttggctgctttcggaaaagaattgtgaggagcatagtctgtgttccgatgtggattataaatagttgccttttttagacatgtctgtatgccctcacatgcgggtgcacacacgcacaacacacatgttaacagacttcttgactaagcaacattttatccatttatagagagcagaatttggaactaaaccctcacggtgacacaccgtttttgtttctcagcttattgattagctagagaggttggttactgtacaccaccaccagaggcatttaaaagatccaaatcaaagttgaaatacattgccatcatagcacattacaggaatctaggatagaatggaattcttagtttttatgaaaacattgtctttacagtgaattcaaaacccctcacacttcaatgaacagtacattccttgctgttatgttgattaattatcataatttaacttagggtgttgaaaaatactaagcttaataactcaaatgcgattgtaataatcagaatagagactcccttatacatttttatttgctaattttcagtgttgaaacatcttcatcttctctccttaggggtcatgttagttgtcttaatggcaaatggaaggatttgatgacagtcatctggctaagctcggaatcaaaggggagaggccctccaatttatatggcaagggagtataggttcagggagtggaagaattgggagctaccttttcaatcttccggactcggtgacctaggatagagacttcaccatcttttaaccctgtcatccaaattttcagcttcatggtctgctctggcagaggaagagagcatgggagaattacaaacgccttcttagtgcttccacttggaggtgacacatgttatctctgttcatatttaattggccaaagcaagtctcatggccatgcctgacctcaatggggcatgtgcctgaaggaagaggagaactggaaatctgggtgagaaattgaaatatctaccaggaggatttttttaacttttattttaagttcaggggtacatgtgcaggttttttacacaggtaaacttgtgtcatgggggtttgttgtacagattatttcatcacccaggtgttaagcctaatacccattaattatttttcctgatcctcttccttctcccaccctccaccccgaagtaggccccagtgtgtgttgttcttctctatgtgtccctgtgttctcatcattcagctcccacttacaagtgagaacatgttctaccaggaggatttttgaatctctttggttatgcataatacgtgtgttcttttgtttttagacatctttaattagcagcatcctcattgttcttgtttcacctttttgcaatctctgtgaacagactttattttccttcaaatgtgaacctaactaaataaaaaaaaggaaatgtgtatctagtgaggggatgatgctggcatgcaatatagaatttatgcccctctgataggaactgttaaagcccatgtcctctcctcagtcagatactggagcttcatcctttcatacaattttaaatgcaaaagttttggagaagtgcttggtttgtacttcacaacagcatctagaaaataaatacaacacaggtgtttatcttattaaggaatacatcagtaagaagctttggttggtttgtaagtaaatcactgaaagaaagggagagagagacttcatatcaggtcgttcaacctgagtcgaatagacttgtcactaaaaatgaccttgtaaatgacaacaaggccccaaagcagtggcatgatctgctaatagaaagtctggaaattgagcattttacctgacttctgttgctcactgctacagtcagaccctgttcccagtgtctgagctccacccatcagcaatgcccagaaaaggaggtcatgaagtcactggaggtgacgcatggtttaaaacattggagatcttaataaataaaccatgctcaggaggtttaggtggagaagggttatatttctctctggttaccagcacaaggcacagataaggacagaggacagcctccctcccccatcacccaggctgtgccggggtggaggccgctaaaaggaagaccctccctccctccacactggctggggctgagccactccagggaagcactgggattcttggcttcagggaacgaccttgcatagcacagaagtcccaggaacagagggactttttctaaattagccctgaccttcagggaagctgtcctgaatgccatatgcacagcagatgacctgtaaaaggttaatttgtctctgctttgtatataaactgtaactcctgcgagctagtttggatttattccttggcatggccatctcccaggtccctcttcccggattatcaagtcatcccagcctgctgggatctggctgggaagtttgttccaggaagcattcgtactctgcagagatcacttccttcagtggttgattctttccatggagaaaagcgattaactaaatcagccatggaaataagcctgtgtaagtatcttactaagtgagtgagttaggagcaggtatgggagtgccagagagttgacctaggatagctgagagctgatggcagtcaagagagggcccaaaagcatgattcacaggccatggcccaacgtgccccactgggctcagggcgaagtgtgacctgtcagcctgggggatgcttagctgctcagccttgactgttgggagatcccctgggaaggtcggagcagcaaagacctgcttctaacagatgagctttgggtttctgtgaatctctaggccaggggacctttggaaatcctggtgaaggtaaatgggtatttgtcttctacaaattcttttttaatgaaaagcaaaattaaagatgtttgtgtatttccctaaaaagaagcaaaatggtttctattagtatgtctcactaggttttgccctttattttggttaagaaaacaaatgagtagtttattttcctgagaagcacaaatgcagtgtttgtcagggtttaatgagtgttgtgcatattgtcatggttccttttgggagcttactgcacattagggcctgcattgatttctttccaggacaggcttcggttggcctgaaggtagacgcaggaatcaagttatgcctcttcatcatatgaggccatgaggctaccattatcaaggacattaatgagttcattgatttggagtgacctttggaaagaataccccaacagctgaaaagtagaaatcccataattctaccaaatggaggaaagattcataatatctgatgttgcttttctgcctgcctgagctcttccctgggccctggggccttacagggtgacccttccctctggtatgatggatgggggtggggtcgtaaatgtgcagaggaaaagcatttcagagacaggcacacaaggtgccatcagatgacctcagttaatatgacagatcctgacctattgtgttcttacctccctaaaatgagccaggaagaacaagagtcatgatgtctatgtggatttttttagacatcctcatcacttatcctaagctgcaatgaaatccttttaaatgccataatattaatgtagcccagtaaaaatatagtagcttgaataatgacatgcttttggaggtactgctgatgtggagatacataaaacaccatcctggaaaaaaacaataacaccggctttatatttgggtttcccttcacaagcctgttgtgaatttcctcccgattagggaggccagcagtaagagagcccagccttccgtttctgtttcttctgataaaattgtgagaatctcaccaggggtttagctacattaacatcaaagacacagcccaggggtaaccggatttggaaaatggaaaaagcaaacattttactattcccagagaaactgcctccctctttagcagtggcccaattttctgctgtaatatttcctatctgaatacctctattagtgatgattcaaggagaattttacctcttaggatcattgagttcaggtcgaaggatgattatcttctttctgtattttggctaaacgtgaacaattttctgcccacatgaaatatcaaaggacataaaccaaccactttacatgaaacattggctgtaattcttcactgccacaactgggtctgggcatcatagatcacgcaagacttgggctttaagaagcactccctccccaggcccctgcagagatggtttctgctgttgagatgcttggggagattcctgcactgtccctcttggggtgttaagtgctgcagtaggcgcttagggcctgaggctgtagctacacacacggttttgcctggggaagtagagaaggtttcagaaaggaggttgtgatttaagaaaacctttgcattttagagaggggaaaagagattataggtacagccaaccaaattagacaaggctgcccttaagcacgtttcagcaaaccagaactaagagcagattggatgccgtattctcatgtggggagggagggagagctagcacagctgtcggggggacctgagggtcatgctgtggggggcctctgctttgtgcactcttgactatagaagttaaccttccctttctgtggcacttctattgtgattttattgctcctcactgagcattttccagacatctgctatgctgtggctgctatcttgcggagacctgagtctgccctcaaagagcttatgagtaaaaggaatgagataaacattaaaataatgtgaaatttaaaaaaaacctagagtcacctgaaagcctcatctttgattttaaaagtgccagagagttgcagaattaaagaagcatttctttaacattcactgaaaagaaattcgtgggaccaaatgaaaagtataaaaggaacatttttctgtctgttatcatctacctagctatctgtctttgtatgtatcatctaatcttctatttatattgcttttagtaaataagaacctcattttaaacactggaaagtattctcagctcagaacgtgcacatcagactggaattagaaaggcacagagatgtcatgtttttaccatgctatatttttgggagtgaattaactgagaaataggaagagagggccctggtctctttctttttaaaaatcattaattatgttatactttttccatttaagtctatcgctcactaaattaggttttgcatgttaccccgctgccacctgaaagtaattaaaagctggttgtttacagctctggagagcccctgtgtgacaccaagaatgggggtcgtgtaaggcgaggggcacagcctgagtctccaaacagctgccagcaaggctccaaagcagccacaatagcagctagtctgcagggcctcagcctgccaggaggagacctgcacccattctgaaagctgcaaactgtgtattgtggagtacaacccaacacagagaagtacgcttttgacttttgaactaccaaaacaagtagatagacacatagagataggtatgttaatattttttctttaaaaaagaaaacaagaaaagaaagcattggggcaaatttagcccagaggatatcaggaggggtgtgtgtacatgtgtgtgatgtgcgtgtccacatatgtgtgtggtgtttggtgtggtgtgtgcatacgtgtgtgtggtgcatgatgtgtgtttgtatgtgtgtgtagtgtgtgtggtgtgtgtgtggcatgtggggtgtgtactctgtgtatatgtggtgtgtgtgtgtgccgtgtatggtgtgtgagctctgtatgtgtgtggggtgtgtgtgtggagtgtgtgctgtgtgtggtgtgtgagctctgtgtgtgtgtgtgtgtgtgtggagtacgtgctatgtggtgtgtgtgctctgtatgtgtgtgtgtgtgatatatgcagggggtgtgtgtgatgtgtgtgctctgtatctgtgtgttgtgtatgtgtgtgtaaaacctcatttgttgggccactcagtcacactaaaatcccccttgatttcctattttaagtttctggaatatgacttgattgcagcgctgactcaggttagctgggtggcctagggaaaggcgtttctatctctctctgtttttgtttttgtttttgtttttgtttgcctcagtttcctcccatggatatgcagtgatttctctagtcctctcccacaatacaatgccaggatattaaaattccaaattgaatattccacttcttaagccaactgctgtcaaagttattttttcactttcttagatttaatcttgcaggatgttacatgcccatgtcaaaggtccccaagcccaccctcaggtttggtgatctgccaggaagactcagcatgtagctgcatccatggctgtgacttaatacaggagaaggctatggagcaaaagcagcaaaggcaaaaggcacatgaggtgacattcagaggaaagcaggccccagctctcaggggtcttctccctgtggaatcactaggaagcacttaatttctccagcaatgagtcatgataagaggtgcaatgttgtctaccaggggagcaggagagctcctggagactcagtggccaaggtttcctttgggggcaggtcacgtaggcaccctggtatgtttggtatgtgccaaagttccagactccccaaggaaggcaggtgctcatcatgaactgtattgcttatgcagttcaggcagtgagccactctaagggtggtgggaacgctgccaatatcctagttcccagataccagccaagggacagtcctgcaagcagcccttcataagactgacagtctcagacctactgtgttaactcttctctgtgccatgcaactttttaaatgatgttggctcatcttcattttcatacattcaacgatcactttgcatatgctcatcatgaaatgctggagaaagcaaatgaagaaaatctatgctttatgtactttattgccttgtacccaagtatttcaagccttaagaaaggtctcatcccaaattattttaaggtctgaaaacacattgactcatactcttcccttgctccacctaagtgtaaatggagttcattttatattctgccattaaggatcttctgctttctctctctccccgtgatgtttggttctttctagacatgggaaacagatggccagctaagtcaatcagatgtaatttggacacaagcatattctctggtctgttgttcatctaagagttttcatttcaggaaaattcaagagaataacaggatcatttaggaaagaatattgtgtagtgataaccataatgctgttagattattattattatcgacaagctaaaatagatgtcacaaatcaagatttgcttagacaatgtgccacagtataagaaaacaggatttgagattgagaaatataatttttgactcagaataacttgctagctactcaagaagtcagtgtgaactcaaggtattgtcgagcagagataaaggtgggttggaccaggcttatggtgctgtgtcctttgctctgggctggagcaggtggaggaaggtctccttaagcagatgggttgcttggcctccagaaatccctcaggcggagctaccatggctgtcagccctttgtggctgtccttctgagcagatggggcaggatggagtaaaccatccagcagcccagacttcctctctcctcagcaaccgcgtcacctgtggaatcctcagtctaggagccaccccgcttcccttctccaccgtcagcctgtggagcgttcctgcagactgggcacattgagcatttatgccagtccggtttcttttttcttttttctttttttttgatggagtctcactctgtcacccaggctggagtgcagtgacgcgatctcggctcattgcaacctcttctccaccgagttcaagtgattctcctgcctcagcctccggagtagctgggactacaggcacctgccaccacacctggctatttttttttttttagtagagacagggttacaccatgttagccaggatggtctcgatctcctgacctcgtgatctgcccgcctcggcctcccaaagtgctgggattataggtgtgagccaccgtgcgtggcccggtcttaaccagctcttcactgattgtctggatgctcaggtgtttttgcgcccgcgtctgtatagctgaagaggtctttcccaagctttttctcagcatcctggagcaccccattctcaactctgctgcacctactctccagtgttcaaaggatcgtaacttttcactctgcaggggctgagaacagctttcttcagatgaccctttctacctccttcatggctcagccccacgttctctcccacaggaagagctgtcctctttccttccagcttagcctcccaccgtgctgccctcctggtccccttacctgctccggcgttctaggacctcttttcatcagctgtgccctctgttgcttcagacagcttctctttagtaattaccgtatttcttgtgacacaggtgctcaggtcccccagttttaaagaaacctttccctttgctaacttccatacttctttctttctctgtctttactttcttccttccttctttcttttttctttctctctctctgtcacacactcctttcattctttctctttcttctggcaaactgtttgagataatagtttatagtagtgagtattttgggctttgcctgttacaatctactgaaattcactacttcaagatcacccatgacttccaaatgttaaatcccaaggctgtctcctggtccagtttctctctgacctccctgttagatgtacacagttgacctacttcctctgttggttcctgtatttggcagctctggacgccaaaacaaaatatcacacactgggtggcttaaacaacagcaatttatttccttatagtcctggagcctagaagattgagatcaggctgccagcatggtcaggttctgatgggggcctcatcctggcgtgcagatggacgccttcctgctgtccttacatgactgactttctcatgtttcttcttgcaaggacactaattctatccgattaggggccacccttatgacccgatttaaccttaattactttcatactccaaattacttctcttagtaattactgtatttcttgtgacacaggtgctcaggtctcccttcccttcccttcccttcccttcccttcccttcccttcccttcccttcccttcccttcccttcccttccctcccctcccctcccctctccttccctcccctcccccccccctccgctcccttcccctcccctcccctcccctcccttcccctccgctcccttcccctccgctcccttcccctcccctcccctccccctccgctcccttcccttcccttcctctttctttctctctctttctctttctctttctttctttctctctttctctctctctttctctcttctacctttattttcttccttccttttctttctttctttcttttttctttttctttctctctctttctctctttctttggggttagggcttcatcatctacaactttaggggacacaaggcagttcatagcagttgctctcctttggtttgtatccaactacactgcctggttgatcttctctctgaatatttcggtgctatctctttccttcagtttgcatcttcccctctcagaaatgtatgtcaatctaaaagtccaatcccatccactttctgtattggtcatttcatcatcttccagggcttcatccatgacttgcacctgtgtgaccccaacttcggacctgccttctctcctggtcctgcttattcactcccccgcatccctctggccacctccaacaaaggaaaccttccccatgaccacaaaggaatttccctttgatttattcatttatttttcaatatcatgactgtattagtttcctaggactacaaaaaaaaaataccatgaactgactggtttcaaacaatagaaatttatttcctcacagttctgaagtctgcaaatccaaagtcacagcgtcagcagggctgtgctgactcagagggctgcggggagggtctctgtcagtactctggggagggtccctgtcaggcctcccagcacctggtgttgcctgcggtccttggctccttggcatccttgacttgcagaagtctcactccatccagtccctccctctagcgacatgtgacttttgccctgtgtgtgtctttgcatttcttctcctcttctaataaagccaacagtcatattggatgaagggcccaccttatttcagtatgacctcatggtaacttaaatgattacatctaccacaaccctgtttccaaataaggtcacattctgaggctccagaaaggacatttttgggggaagctatttaacccactatgattacaaattcttccaattctttatttgccctctctcacacattttatatctttccatctcctgctggacacacagtagacaactgataaatatatactcaatgagattcttaaaaaaaaaaaaaaagcatttttaagggaaggaaacaaaaagcagacagccccatcagggtagccaggagtgctggtgtgccaggtcctgtgggtccctgcagccctgtccccggcggcgccagcatccagctggcagccacaccaccagctgccgctgtcccagctgcaagtagcctggtctgtgtcagaacgggctgggggccagtaggggacaggatccaggcagtcctggaccaagcacaggggcggcaggcaagctgcttcacctgcatttcagatcctcactttcgggtgccacggtttattgggcatcttcaagtcctgtgtttccttcctcaaaaggaaaagggggaaatttgttaatggacaaacgactcatcagtttcccaagtgattagtagtctgaaaacatgtgcatgaaaaaattgcctcaaaagttacccttgattacaaaatcaattccaaacaaactgaatttttattggataaactgtcacctgtggttgaaacttcaacaactagattctatttgcaaagttgtattgactgtccaaggctcatgtatgggggaagtaatgagagtatttacagaatatttcagtgtgtgtagttcctgaaaatacagttattccaaaattaattccaaactaactgaatttttattggctaaatcgtcacctgtggttgaaacttcaacaactaaattctatttgcaaagttgcattgactctccaaggctcatgtatgggagaagtaatgagagtatttacagaatatttgagtgtgtgtagttcctgaaaatacaatgatgctgctgaaaatattggctgtccagaattggactttatgagcaacagaaaatccacagcacacactgctctgcagtagagcagagtcaaaatgttctttgaaaagaagctataaacagatacagtaaataagcaaaaatacacagatcctgtgtgctcttagaggtggtttcaggtttctgcatgtctttcattttgccagcagcgcacagcagggcttgggtttgcactcagaggagcctggctttgggtccctactgcacagttgtgagaccttccatagttaaatacctctctgtggacctgggtactgtgtttttataaagatgaagagtgccataactgcagtttcaggccaagtgaggtgctccatgaattggaacatagctaagtaattctggacctctaggtgtgcatttctctatagagcctgtagatagtgtggagcctgaagccagtgtctaggtccataccccatattcaacctggaccaagttacgtaaccttgagttagtcatataaccttgctatgcctcaatttcctcaactgtaaaatggaaataggaataaaaataacattatagtaagattgttataagaattaaatgaattaatataggtaaagttcttagcacagtgcttgacattaatgtttgtcattgtccttcttcttcttattattattatcattatcttctgtctaaagtgtttgtatcccagaaaccagaaggtcaggacaccgtggtttcaaaacaaataggccgttgtttgtgtgaggcttgttaggaagtaaaagaaaagtagttctatttaagaattgctaaaatgcaaggtatgctgaagaagtcatggggaaataatccaaaatccttcaatttcaacataaaagcattagaatgctattgaactaatagtctgtaggattttaaaataaacaactctttacttatttattaaaacgtttatttttcttaaatagcaaaagtatgatataaaatgacaataaggcagaatgaaaggatcttatattttgccttaaccatcacagctaaatcagagtatgtatttgcagtaaacattagtatttacattaaaatacttgtagcacatgtcagttattgaatagctaacaattctatggcatgcacatgtcaggttatacctaaaaacttctcgacaaccccattaagtaattgcttttgtcggccccactttacagatgagaaggctgaggcagagagagcttcagtaagtgacccaaggtcctttcttgaaattctccctctctagaagatagagattttgccttttcttaaactttctttcagtttcccatattatgtacgtgcataagagccaacaaatattgtcgactgaatgataacattaccattccagacacatagtagaagcttaatacatgtttatggagtgaatcttgaataagaaacttttccatgagagtggtggtgttatttccttttaaattcttcttaatgctttaataagagcttttgcttttctatatttttttctactactctaaaatcaaatttcacatcagcctctcctcccaaggcaaagagtgcctgtgttggccaatcaggggcagcctgggatttcatagctgacatctcctacgtgatgccgttctgagggaaatcgacatttcaaattcccagtatttattattcccaaaacaaaagctgtcttcttttattttcatgaaatgattttattgttggaaccacctacagctttacactgcagcatttgttaaaaagcaggacagtgcaagtcaaggcgaggctgacatgccgagaccttcagaggcgcgttacagcatttcctgatgcactgaatccatagccacaccacgagcctcagactttactttcagttttttatctaaagggttatacacatttggtgagcacagagtgtcaacctgccatggatagcttttgtgtgtgagggcatgttgtttcaaatagtgatcaatatgcttcaccaatttatgatgatggatctaagaatggtagaatttctgtgtggagaagcttcagggtgtctttttgagctggatactggagccctggaaaggttacatgggggaaagggatggcaaaaatgacagctgctgagccaatcagatcacccacacgcgcccatatgaggatgtaaatatcacctagatcagcctcccatctctatcactggctccgatttctcatcggagaattattttatagatgaagaaagcacccagatgtgaaaagtcacctgagcagtgaatggcggtgcagggactccaacctgggattttgtggtggttgtgtctgcactagttctgtgttcagttgaaaatttctccattactgtcatttaagcacttattctggataaggcaatgcttttaaagttgccattttaaaaattatatgacctgttttaaaaagacacaaaagagatagaaacacgccagatataacctaattataatcagtaggcttattatactgaaggaattacaaagacttatttttctgaaagaagttcattgaaaactgtacttcccaaaatgattcattttgaaataaacttataactgagctttacttcaatatcaaatatttaaaatatactttaatgcaaataatatgttgtatatctgaaaatgtttacctgtaatttctgaaaaaaaagtattatatataaatattgtcttagattgtttgggctgcattaacaagttaccatgcattgggtggcttataaacgacagaaatttatttctcagagctctggaggctgggaattctaagatcaaggaggtgggtagatttggtgtctggtgagggttctcttcctggttcatagacagctgtcttctcattttctcacatggcagaagaggcgaatggtgtctctggggtctctttttagaagggccctaacctcattcatgagggctccaccctcacgacctaatcaccctccaaaggatccacctcccgatagcatcacattgaggtttaggtttcaacatatgaattttgggaggcagggaaatagatcttcagtcgatatacatatttttttaatagatggaaatatccttaggccaatgtttcttgactttttggggggatcatggacatgttgagtaagtaataaaagctatggggcagtggatcttcagaagaacacaccagtatcgaaagctgcaacagtccaggccttttttgcttcctttcaaccttgtgactatctgcattccctcaccccccggctcccacttgtccttacccagattaaccagggattcatactccattaaaatgcctgatatagatgttggatcgtgtcttcctttttttcaacctaaattgcattttgaaaccttcagccacactcttttctctgatctcttatttgtcctggtttcctctgcttctttttatgcacacatttttttttatcctcctatgcccattgcattgtaccagtatctttcactacaattgttcttgtaccaggaaaagtaaagggtttttataaaaagccttcatcaagtcattttcaaactgcagatgatactaggaaagaaaggccatactgagattcccccccggctaattagatggtgaaatttttagttctcagcattgttatctgtttgaattgaaaccctatcattgaaaaagccaaatgaacttgaaattgaggagggccatttcccaaaacggaacgcagccaggctgaatccctcggtggagagccagggagcacgaggcccggatgcacgtgactcgtttccacagttctgatttccaagcgaagtaatttgttctttaaaaaagttattctaggattcaagactttaaaaaaaatctgtattgccaaatgcttaccatgcatgatgaaatattgaagaaaggtgtatctcagccttgcaggtaatttttaaatgatccacaaggatttattcaaggtcagtaaattctgtgttcgaactttccatgtcagtctgtgtcccacactgtgtccccatcaagtcaattcctctgatgctgaatctactctattccttgcctctaagtaaaaaaatttttaaaaattaaaaaacaaaacaaaacaaaaaaacaagcaaacaaaagaacaatacggcaatcgaagtctcaagcatttcctcttttactgaattcgacacaattccatcgctaagtagagaaaacctgaacatcctattgctggccgtgcctcccagggttctccagtaaaccttttccatgaaagcctgaagtccatttcagatgcaaaacatgcagaacctctgggctccgcgaggcctgatgcatgactttgataggactctgcacatgcttagttgatggtcctgaacatgtgtattttcctgaatttcttgtgctttttttactggctttgacttgttgacataagatgaatgtttctctcttgttttatcaaaatatttaagtgtttttagttttgtattgagatttttaaaaacaaagcttttcttgctagtaaggatatggatgattactttcttttcaagaaaaatggtgaaactggaaaagtaatttcatgtatttaaaatatacacttgttgcatagttattgatcagtttataaattttacacctttttggtggtgggaaaaatatattcatagtgacttctatcttaaattctggatctaagacgatgctgctttttactaatagtggctatagagtatatgtgttcttgtaaaatggttatgcagaaggagaataggaaggactatagatatgtgattaaagatatttctcttttgaagggttagttaaattgaggaggcggcacgagggacaaacattgtaaactctgtgtaacagcaaggatattcaaggtgacaaggatcagaacctctgtgaaggttcagtaaaattatttgtgcacatcaggttattatataggatgtaaaaatccagttttatggcaagatttatttgtttatttgtgactaacatatacgacctgaatttaaaaactagaggcaacactcatagcaatttagaatgcagcttttcttgtgatttaaattggacttatttttctttagtctccaaccctttcttagaagaattatggtggaacagaagctgtaaattagggacagttatttgaacctagttacagaaacgaagttattggcgtggggattctataggagggactctacattggatggaaatgaaggaataactggaagaagaaaggagcaaataggcccaagtatacatttcactgtgtgaacccataattctctctgatagctgcatgattaattcaaagatttattgatttttcccttctctactccagcctgctgacctggttttgttgacaggtttgtgtggatcaagccaatctgacagatgaaagtgtgctaccatattagtccccgtggtctggggcaaatattttatacagtgtccttatcaacagtaaccgaacacatgtgaggcatccgtcaacactccttcccatgccatgccatgaaatagactcagagatgccagccccacagcagaagcagctgggattattcgttttaatgaacatgcatcgtgtgtacgtgtgtgcgcgtgcatgtgtgtgtgtgtgtgtttatataatgaggtgggagtgtggaagttatggcatttttactcttagtaacaaatattaactgacagttagcttttaaaaatacctttatgggccgggcgcggtggctcacacctgtaatcccagcactttgggaagccaaggcgggtggatcaggaggtcaagaccatcctggctaacacggtgaaaccccgtctctactaaaatacaaaagattagccgggcgtggtggcaggcgcctgtagtcccaactacccgggaggctgaggcaggagaatgccatgaacctgggaggcggagcttgcagtgagccgagatcgcgccactgcactccagcctgggagacaaagcgagactccgtctcaaaaaaaaaaaaaaaaaagaaaaagaaaaagaaaaagaaaatacctttaatgatacctgagatttacttcaaaacaatccattgccaggggtgaggttgtagcctgaattgataatttctgaagctgggggatggtacatggaggtttattatactcgttatatccttcatgtgtgtttaaaatattctataatgaaaagttgaggaaaaacacctataagacaaatcatattttttacttgaaacttcagattacatgtttaaacatgagcaattggcacatgaccaagccaggaataggcagattataaatgtcatattttaaaaattaatgctacaacaactgaagcatttttctgttggttatgagctctaaattctggccaaagactagaaccacaaataaaatggtcctttaagactagtgaatcatctccaagttgagtgtattccttctcagctaataaaatgagatatttttgaccaacatttctcaaactgtgtccatggagagattaggaagatagggaaaagattatgtggattctggttcaaaaaattttaggaaataatacattaagcaatagcaacccagttccatgcagcacgaatgtcaaagtgattgtggccactttttaaaaccaattaaattagtttatttttatttttattttctctttttagatgtattagtccattctcacattgctgtaaagaaatacctgaggctgggtaatttataaggaaaagagatttaaccggctcacggttctgcaggctatagaggaagcatggtgccagcagctgcttctggggaggcctcagggagcttttactcatggtggaagtcagagctggagcagaaagttcacatggtaaaaacagaagcaagagagagtgagggaggagctgcatacttttaaacaaccaggtcccatgagaacttaccatctgaaaaatattgtggatagtgctaaactattcatgggaaatccacccccatgatctaatcacctccccaggccccacttccaacattagggattacagttctacatgacagctgggcagtgacacagatccaagccataccaccagaccactcatgttattctatagaatataatttagaaaaaactacttccaacgtaaggccactagaggtgatttgcataaaattgaggttgtttaaggccttgagttcaacaattcagggttaaatatgagttagatgttttcataggaccaaacaacatttataggtcttgaataaatctgaaatttctacttttataaagtctaatatgtagatacactgggtttcattggattctaattccattttttgtattttggggggggcatcatttttatctttactaccgtaaaacaagacaccatcacagccaactccaaatggccagctgtgaagtggaaggaaagatggaacaagaggcaaccaaccatgtgtgggtgctcaggtggaggggactgtggttggtggaagacccctaagtggagtgagcttggatagggagtcaggatgggaggtggccagggaagggatggggcagggccagcctgcatatgaagggccttcctggttaaggcaatagctttggatttttatgcagggataatggcaaactgttgaattctgggctggggattgatgtgactgctgttgctgtgtggagaaaagtgcgggggagagcaaacataccattagatgactagtaggaggctggtggagactgacttgagtggcagacatggggacagagaaaaaaaggacagatgtgagagatgtttggggaagctttggtatgttggctgatagattagatgtgggggtgagagaaagacagtcatcaaggatgattcaggtaaggaatttagtgcatgttggtaccatcaataggtgtggaaactctattatttaaggttatcaatcagaaattgaatagcattaataataggcaaagccctttaggcactctgttcttggtgtatatgtgtgtgcggaggatgtcctgtgagccacttaggctcactataaatatctttctgaagccttccttgaatatactactctggcctcctacctttgctcaagctgttttcttttttctgtttcaccttcagctttatcttactcatgctaggtcagacttatcactgacttcactgcatttttgttggctgatttccagttagtcaaaataaaagaaagtggatagttttggcctttgaagcaaaaagagacacagggacctctctttccagcttccaactccggatatagcagttgatggtcgacatctcacagtaattattaggcactataattttgctaaatttacttaagctaaactaaagaccaccaagagcaccttctacggactgatgttatgtccctctctaaaagccatatatgttgaagccctaacccccaatgtgactgtatttggaagtgaggcacttaaggaagtaattaagattaaatgagggcatcagggcagtacctaacccaataggactggtgtccttataagaagtgggagagacaccagagagcttgctctttctctctctgccatgtgaggacacagaaggtggctgtctgcaagtttggaagagagccttcaccagatacacagtggctggaaacttgatttcggactctggcctccagaactgtgaaaatataactttctgttgtctaagccatcctgcctgtggtattttttgcagcagcctaagatgactaatacagcacccttctgctcttctgtctgactgtggtttcttggagaactgctgtcttatattcttcttacttccaatggtcattcaatttccatacggtttccatgtagtctaatgtcagttcatttttataaatttaaactatttttccatttttcccatagtcatcctttttttttttttttttttgtttaaggaatcatcttgctctgtttcctaggctggagtgcagtagtgcaatctcggctcactgcaacctccacctcccagtttcatgcaattctcttgcctcagcctcccaagtagctgggactacaggcacacaccacccaccacacctggctaatttttgtatttttaatagagacggtgcggggggggagtttcactatgttgaccaggctggtctcgaactcctggcctcgtgatccacccacctcagcctcccaaactgctgggattacaggcatgagccactgtgccaggcctctttgttcatgttagtgtatggagacttttttatttgttcaggctagtctgttcgccttttcttcctttgaagaaattatctgttctccttataagttttacagtgttcaaactttggatcatgtctttttctctctttgatctctttctaaatatccctttatttaaaactgtgcatggattttctcctaaaatcatgtggtgaggaaaatgaacttttacatttcttcaggaaagtaaacctggtcaaagactacagttgggagaaattttagacactcacgtatgtgactagactgtggatgtgaatggtgtctcgttaagcttgtctcaggctttcatatggcaaagtagtatttttaagttctttttaggtcctgcctttacctcaggatgcattttcttataatctgattacaatattttttaatggagactattttctcttgtacaagttatatgacaaaagtacatttggcttgtcttctgtttgtttgagttgattgtgttctgattaggaatgctaagtcacctatgcaaaagcaactgagaactaacttaaaaacatgaattattggggaaatgtttgtacacccatgttcatagcagcattttttgcaatcgccaaaagataggaacagcccaaatatccatcacccaatgaatgagtaatgcaaatgtggtacataacattccctggaggatttgtcagtcttgaaaagaaagagaactctgacatatgccacaacaatcttgagggtattacgctaagtgaaataagcgtgtcacaaaaagacaaatactatatgattccacttatatgaggtatctaaagtagtcacttttttttttttttgagacggagtctcgctctgtcaccaggctggagtgcaatggcgcgatctcggctcactgcaacctccgcctcccgggttcaagcgattcccctgcctcagcctcctgggtagctgggactacaggcacacgccaccacacccagctaattttttttttgttttagtagagatgaggcttcaccatgttggccaggatggtcttgataagcagtcaaatttacagaggcagaaagttagaacggtggttaccaggggctggaaggaaagagaaattgagaaattgtttaataagtaccgagttaacaatactgaactgtcctctaaaaatgggtaagatagtaagttttatgttacatgtactttaccacaaataacttaaaaaacgtattgcacctcttctcttaaaatagctgcatgggaaaattgattttatttgtaagtaaagacctaggtgaattaacttgaactagtactatattgtgacattgtattttataaacaacttccaaaatcataatcataattattttgtcctggtatttttttaaaggatgtgtgtgatggtattgaatttggacttttttttttattatagccatatgttgaaaaaaatcaagccttagaaaatgaaaagtatattgtaggcttaaaaattataataacatggtcgggcgcagtagctcatgcctgtaatctcagcactttgggaggcctaggcgggcagattacctgagttcgagatgagccctgccaacatgatgaaaccccatctctactaaaaatacagaaattaaccaggcgtggtggcacacgcctgtaatcccagctacttgggaggctgaggcaggagaattgcttgagcccgggagatggaggttgcagtgagccaagatcaagctgctgtactctgacagagcgagactctgtctcaaaaaaaaaaaaaaatatatataacaacatttgggaaaatagaatgatagtaattttatctgtctttatattctttaacactttggtgactgaattatagacaactagtgtataagctacaggaaagcagagattttggtctgttctgttaatttctagaatagtaactggcacataggaactccatgactcttcatttaatgagtacacgttgagagtatccaagtactaattactctttgggcacgtggattgtggaagtgtggagaccagtccacagttctcctagatataaggagctttccctgtgtctgttgatcacataattattcatcagtgagctctttgttgcttttgtatcttagggtaaataatttaaacagatcatatagataagacactgaaaatctctccactgagaggtggagagattcgtctagggtctcaaaataaatgactaacagaattgttctctgttcaggacactaagtgatgcaagaaatatttagtgaccaccgactctgtgaaggtcttgagcttggctttgtgaatatagctatgaataagagaaatacgcaatccctgcactcaaggaatttattatctggtgtgtgtgtgtgtttggcacggaggtgatataactgcttcctgaactcaatacaatcttttcattacagagcctcattttagccccaatttctgtatcttttctttgtttttttcccaatcactatcttttgactggactatactactgaaaggaagtggagtccttaggcatctctgggtggtctggagtgatctcatcttccaggaaagctgttacacagacgttagtttctgaaaatgatatgacatgcagctcactgtaatacaatctattaattcaacagataaagttttatgttctaatctcccagaatagtacttaaacagtttagtgcacatgaatcacccaggaatcctgttaaataaagcagattctgattgagtagcttggtgtggggcctaggattctgcatttctaatgagctcccaggtgttgctgaatctgctggtccaaggctggtattgtcagtgacaaggctgcaggttcttagccctggttgttcattacaaccccctgggtggatttttacaaataccaatgcccttagagatttgctttaattggtctgggcttgggctccagcattcatattttgaaaaactttccaagtgagttttatgttctaccagcactgaagaccacttccctgcacaaacacaactgatgctgcctgtcattgtgtgtaactgaatccactgatgtgagttggtgcatatcagtaccttttataaatgcaaggaaggctggaggctggggaaattgtcataagacagcacccagtgcagggactagtgtacagcagtgtgtttgctgaataagtgagtgaggcaacgagtcattttcagacactgtagaggatggctagtgactggatcccagtgctgttgcctggagctctagcaactgtatttggtatctctaaacatgctggctatgggatagcagagttaatagaatgagactggggccttctacttccagataaaaatttggaaaggtattagaaggaaggtactggggaaataagttttgatctatgatagataagataattgaaaaccaaaccaaagaaattaaattcagagtggagaggtgtattagtccattctcacactgttatgaagaaatgcctgagactgggtaatttataaagaaaagaggtttaattgactcacagtttcacatggctggggaggcctcaggaaacatagaatcatggcagaaaacaaagcaaacacatccttcttcacatggcgacaggagagacaagtgccaagcaaaagcggggaaaagccccttataaaaccatcagttatcatgaggactcactcactatcacgagaatagcatgggggtaactgcccccatgattcaattacctcccacctggctcctcccacaacatgtggggattatgggaactacaagatgagatgttggtgaggacacagccaagccatatcaagaggcataaatcgaaggtagccttccagggactgaggtcagatttgtcccaagttagacactttgggcacatattttcaacagacattccacaaaatatgcaagtatttattttttgatagtatgtttaaatacaaatagaaatcaagccttaaaaatgactcgctgatgaaactacatttctcctgctcgggactgcatttcagatactgtccatttgcatctgggtccatgatgtgctgttgaaataacatgaactcagcttgtaggtgaaggtggggagggaaacatgcatttttccatctgaacagaaagtgtgttctggcttttttctgagatattatttttattgaattttaagacccacacaggaagtggctttcacttggtttcatcttcctgatcagtgcatgttggggacaaaggagagaggagggagttaacctggataagtctgctgcttcttcgggagagtggggcatcccaccaacctgctgcccatgttgctttgtggggatacatgaagcagcttctagaaaggcttctctaggagcttggtgaggctgtgcaatgccttttttgcaaaacgcttgctgttcactaatggagcagatgaaataataaagccaaccaaggaagcaacttaatggggaactaaccagccacagtggcttttggaactcttgtgccttgctgcacatcactttgaagtagtctgtggagtccatgcttctgatccttggaacatttggttcatttttatgtcattgttgtctagcgctaaccgcaactggtcccatagacctgaagtagcccaggtgcaggggcaaagcagtggccaggtgtgagtgctgagggcctaaatatttcaagtacaaaacgcccaggaaaacaaccaccgggggctttaccatacttataaaaaggaatccttccctctgaaagcctccagcctgactgtaggcagaagcagaagcagccattgcccatgcaaggtgaggaagaacaggtgttggtgaacagagtgggctcaggtcatcatttgtgtggcaaaattctatcagggatgaaagtatcagcaatgggaccacctggaacccaagctctgccactttcttgctatgtgatcctgggtaagttatttagcccttctgttccgcggttttctcctctggaaaatgatgaggatgatactactctgctcatagggttgttttaagggttaaatgaggtactgcatagaaaacactcatctcagggctgggcatgcacagtgcatgggtgtagctatcatcatcctcctcatatttagaatgcttttctgtggccacccatcatcagtatgtgcctatcttcatcagcagtgaagaggacagaagcttctttctcccttcctggcatgctggagatgtggttggtctcctcaggttaccattaaattgttggcagtccccactgagagtagggatgcagccaactccacaggcacctgaggagctggccctctagcaggtgtcagccaggagagacatttaccaaactgaagttggggaaaagcctgagctgattccacactctaagtcaccttagggcccaaagaacaggtggcatgagatactcagggaatgctatggcagcgtgcctaaccatggttctgcaatcttcacacccgaggtcatggcagcggacaatttctgtcttctggataagatgggggtgtatctgtctgtgagcattcattcactgattcattcaaagtggatggattgggcattgccatggaccagacccggcacagatggggtgcccagggtggaacggtgagcagtagtgccagctgtgtctgtgctcatgggcctatggtcttggggaagacctcaagtaatcatgtaaataatgacctgcttacaattgtgagacctgctggaaatgaacaacaggagtgggggctgtacggggaatttcaggggacctggcctgtcagaggtcagggaatttatgccctggaaagtgacaagttgtcctttagattggttaaagaaaaatgaaagtgcggagaggacattccaggcaaggggaacaggtgcagtgggcactcacagaaggccaaggggacagccctgttccacaacagcctgctcagagtccagtttgctccttgctcctgattggagatttttcacatactgtctcccagcagaggattctgtccacaggtattgacagggcctggctggtctcttcttgtcattcaagttgtagttcaggaaggatgcacccagaaggctgcttttgactactcactctgaatttgccacctccccatgcccagcctgcctctgtgttttctttgaaattctgccgttcctttattcctttgcttgctatttataaagaaaagaggtttaattggctcccagttctgcatgctgtaaaagcctggcaccaacatgtgctcagcttctggtgagggtctcaggaagcttgcaatcatggcagaaggtgaagcaggagcacgcacaccacacggggaaagcaggaacaagagggagagaagaggaggttccagactcttaaacaaccagatctcctgtgaacgaactgagtgagaactcacttatcaccaaggggatgggaggtccacctccaggacctggtcacctcccaccagaccccacctccaacactgggaatcacatttccacatgagatttggaggggacaaacatccaagccctatcacctgtgtaccatttgttgcttctcctctgaacaaaagtcctcaaaataggttcttcgtcacatccactgttgtcccttattttcaggacactgtctgacaatctgacaaggaagtagtgggcactccacgtctgtggagcaatggacagtggctcccagtctggccaaatttccctaacatgaaagcatggaacacttcctctcacaggtcaaacgcgtggaatgaatttgcaatgcaattctcggcacagctgactttccttgttgcttctgctggttttgatcactttccctggggtgctgtgccatcaggagcaggggcctcctctttcctctcctgtcggtcctctccaagtgatctgcaacttcatcccggggggaaacagggcagggaacttcctcctcaatttctgatattgcaaggtagcaaactcacacaggccttgataacaataaatgaagagtcaggtctttacaaatatgatgagaaaatacaatggaagtcccagtggggagtccccacttactccttccatgccaatacagatctccctacagactttaccactggttctatatatatgcgatgccagtgggaaggtatttctcagccgttagaataatccatttcctttatcccggactatggataagaggacatttgcaggagaggggagacacttaggaagaaaagactggctttgtgaatagaaatacattatttgtgcatatgttgtagctcgactagactttgagcagactgatatctgaaaacatatttataagcctgttataaactcataattctaaaatattgaattttatttattttgcatctataaactgagttttgaatttgtgcagtaatttgcattattcagaactcttgattgcaagtgacaaacagaaatcaaaaaaaagtcttattggctcacagaactgaaaactccaggagtaactgccttcaggcccagaagcatcaaggtgtccagaaactctgacaggagcacctctcactcttgctgtcagtcttactgctcttggagtactctggtttagattggctccttggcatacctagcatggcacgttgcacacaaccccagtgacagtagctcagtagccagggggaaagagtcttctttctccaaaatccctgagaagggtcatgtcacatgcctatctgtgaacgagtcaccatgtctaggggcacagaggtgatgaccttggtctcatgcccatgagggatggctcctcaaaggaaaacccaagtgctcttattctaagagggagaattggatgcccagagacaaagtctatagatgtacgtggtccagtgttgaagcggtgggaggagagtgccggcaacacaggcaattccacgttgtgtgcgactggcctgtgcatatggaggtgttcagtgacctggccctggacactcctgctaacaggacacacacatactctcttacacacatacatgtccacacacaccacacacacacacatatacaccccccccacacacacactttgacatacactcacatgcttatattccccccacaccatgcacagacatacactcacatgcacatatgtcatacacacaccacacacactgacatacatacacttaacatgcatacatgcacacaccacatgacatacactcacacatacacaccacacacatacatactacacatactggcatacacacaggtgcgcacacacacacactcacatgtgcacacacacacacatcattgacaactatgaaaagcccctgcatacctcagagcccctcaagctgggcttctgatgacacctcaggcactctcccctttttattttgtttcccatttacttcctaccttaccctgttcaggctgccgtaataaagtttgatggactgcgtcgctgaaactacaacagttcatttctcatggctctggaggctggaagtctgagatcaagatgcccgcagggtgctggtgagggccctcttcctggtggcagaagccgacttctccttctttctttgcctggcagggagcagggaaggaagtgagtggtcttgtggctctctgagggcactgattccattctgccccacctcccatagcatcatgttggggaacagggttccagcatattaatttaggggacacaaacatccagcccctaacacttccattctcattaattgccttcaaagagagctaagctaatcctaatggtaactttggcataaagcaaaactttgagaagatgacatctgatatctgctgttcaatgcatgcttgttgggagaagagtgttaagatttggactttgcgtcacttatggccaaaataggacgctcctgtatgtctgcacttgaatttaaatatgccagtctcaatataaagcacggaactcatgctgtttaagcaagagcacatattaaggctggcatgtctgtcaagataataattttgatagaggattaaaaaaaggaaaaaaatgtagagaactgaaggtaaaagatagccaggattagacctttcaatattaacagtgaactttctttagatatttcttacataatcatcaatgcttataaattctagtgcttctgtcttttcacagtgttgtgtttttgtttgtttgtttgtttgttttaacaacgtaatgtgcttattcctcaggcttcaggtaacctctgtaattacacacccagtgctgatgcccacgggctgccacaaggctgggcatgttactttatgctctaaccctatgtgttcaataagtactttgaaaaaaataatatcttgctaggcatattttaaatcataaaaatctcaattttagggttttcttccctcaaatgttaatttactatattatttacacttatttgccaaacagggaacttttgctcaaagaaacaggtgcagttttagaagctgaaattaaacacctctctattctcatattgccttttttccctttggacacgccccaaagcagacatcctgcttacaaaagagagcttaatggcctccctcctgctctccctgcctgaagtctttctagaatttggaaatatgtccattttgttagggcaatctgttagtgttaatgattttatcaatctaaactccactaaaagaagcaaatcaacacaatgctaataaattctgtttgttttctaatcccaagaagacacaataaattaacatacatttttaattttaattataaaacctttcaaatagggatgttgtctctcttatcctcactgtcattcttgtgcctggtacagagcagatattttgtgagggttatttttgttgtcgaataattgtattttaaatacacagaaaaggacagagagtcacaaaaacaaaaagcacgaaagaaaacaaaaaccaggtacttaagcccaacatagagtcagatgtttatgctttgccacatttcattcattcctttttttatgaatacgagtgttagatagaattgaggtcccactcacattttctatacacatcttgaaacctctgcaacgtatttgtgaatctgtaaaccatagaaactaacacagtgtatttttcaaatgcatataaatgatatcgtgcatgctaagatttttcttagatttcctataaatcatttcaatcaaactctccctacttttctgtggaaactatgtaacaaaatgctctatttccggaagcctccaggccaagggtgagtgagcctggggtgttcaaatgtaatcagagtccaaaacaggcccttgcttgggctcaaactaaactgagttaagaaattagcctggaagggagagaaggtgatgtcagatcttaataggataacattgccatgagttctccttgcaatagaggaggctgcttttcttcagcagttattgagatgtatgtttcttttttcactaaatttctgttattgtcggttgattttgaccacaggttgttgtcttattgtcttgactgtcaaggacatataatggcagagggattcttaggtcagcagacatgctctcagcttaggcaagcctcaggggctgtatgtgtttcagaatttctcacattttagatagctatctaaaagtaaatgttaccatactctgcatgttttctacaccctcacggtggaatgtggggcagtaatgcttcaagatttcttcagcagaactgtggaatttttattctgtgtgtaatgaacaaggctcaaatagaacctcacgtccatttgggccatgttttggcagcaggtgaatcatgaaaatactttttcatttttgaggtatttttggattgtgggattgcagataagggattgtagatgggtgttattgttgttgttacaatataaatttctataacttctggccagttgttagaattatcccttgtttttcaatgttgactcctatccctccctacctctctccctcctcctttgatttcttctttcctgctttccttccttcctttctttctcttgtcatttctttaggatttgaagagagggcacagtatacgatctttaaggactcagattttcaagttaagcatatctgtggccaaattatctttctgctgctcattaactgtgtggccatttttctatgtaacttcaggagtttcagtttcctgagataatcatatctacctcctgtggttttgggaagatgcagtaaggtgatggatgtcaaaacatttaacacagtctttagcatataactagcacttgatagatgaccactgctagtattgctgttgtcgttaccatatcacacagcatgcaccatttgctattctcttttaagcaatgaatttattcacattcaatttcttgaacatttttgaaatgcatctggtcttcgcttacatgtatgttatttggcaacctgtctgaaaatattattaattatggtttctatcgttggctttagctttaaatgttgcttgaaggcccctggcacacagccatgcttgaccatgtgaggaacatgatgctgcccccatcaggtacagcctaatggggtggatggatggatcgatcgatagatacatagatagataatagatagacagataggcagatagacgatagataggcatatacatagatagatagataattggtagatatgcagaagaaaattagatggtagaaaggcagatagatgaaagatagatacatagataaatagataggcatatacatagatggacagataactgatagaacacagatgatagatagatagataatagataaatagtagatagatggatagtagatagataataaacagaaaacagaatagatatgagagagatgatagataactagagtgatagagagatgagagagatgatagatagatagatagatagatagatagatagatagatactcatctgatcaccaaacaggtgtgaacagaggatgttttaaagtgtgggattctgcatttgctgtgaacaggagtacaccagacaatccttctataggaggaagggaagaatgcatggggccaaggttttattttgctaagaaatcatagccttcccagagtttaattgcctccatttttatcaaatagttagaaacacgactattttttttgacccttggaggcacattggtgacatctgtgggggcagcgttactgatggttgtccgtctgtatgttgctgagccctgcaatcctggtatcccaagatgcctcccctcttccaaagaagcacttaagagctcaagttgattaccgcaggggcttgaagacgaagcctcatttgcccgattatcagaacagatgaggtgtgcacacagcctttgcaactttccattcatctcaggaactaaaatgagtaatatttttaagactaatgtcttaaatttatgattttatttgattctttattcagcaatttgaatattatggttgattacaagtacataataagagcctttctgtgattggcattttcatttttctaggtaaataaagtacctcttgatctgtttttatttttcttcctacccccactccccccatcaattttctttcacttgtgtttctctacacatactgtgggcatcccaaggggaccgtagtcttcttgttcatgtttcagacttgtaagtcgtatgcaaatgcagccatattttacagattggcaattttgctataattaagcttcatgaatatgaagattcttgtagaattcccaggacgccccatggtgaggatttgcaatgaaatttcttctcagctcactgtgacctattagagtgtcagtttggctcagtttcaacatggtgtttactcttatgaagtgcaaaccacttattagctaatttttaagccatgacagaagcagcctgagaggcacatttgtccagagggcttgacaaaaagctagaaggtcagtgtcttcacagacccactgaggttcagaaattaaatgataattttgtaaaccaggcaggaagtgacatttgtgcaattgcctttgatatgttttctttggctgtgtttggtttctttgtctctgcagaatctcagaatgagccagcctctaactaaaatggcgctgcttcatcttaaaatctctttgtgacagcttatgacaggagatcccttggaaccctggttctctgtgggacctttcctggactcctgtgtctgcaatacaaatgttaattctcagctctattaatacctcaatatcacttaaaagatatccaagggaaactttacctggccaatttctttccacaaagtagcatttctgaattggagattgctggttggctcattcttattttatttacttttgtaaacaggttatcatttataattcaaaactcaaaaagcatacagaaaaaattctagtctcactccagtcccttactctccattccctggtatgcctcccccaccctcaggtactaatagttattcatcggtatccaaccttccagaaattctcttgtatatacacaaaacaaatagaaatgtatcactttgtaccaccagtactttagaaatcatttcagcatgggtactcctgcggggtactccctgatcagattgccgcgttgtggaagatttctttctgcctgtcaattttatttccagaaaatagtggtcacattgctttagggtaagtcaccaaagggtgtagctgcgcctgtgtctgtgcagccctctggtatcctgttctcagctgaaaataaagccctggaattggtccatttcactttttctttttcttgcagtttgaaaggcacttgaactagcccactaatgttgctttttactccttttacattttaaaaggagtcgtaccctggtttatttgcttttattgcctgtgaaaatggcctgagtaattagaccaacagagaattgcatcttaagggctaattattgatatattccttgtgtcagctcaaaagtaacctctggggatagaagattaggcagagtatgcctgcccatgaatatacactgttcatgcctctctaggcttcaacacacacaaggtcatgtaaggcaaccttacctaccccattagggtccagaaagatatccacctaggagagagtgtaaatatcacacccatcaactcactcttatgcccagtggctcatcctttcaaacatgcaaaactttctataatggggaatctgaaatactttaacaagtttaaaaatctttattgagcacagattttgatttttaaaaaatatttttgatagacatactatggttcaagtcccatacttgcattaaagggttaaggtggaacaatgcttcatgcacagttagcatttcatattttttgtccagtgaagaaaagaaaacattctcaactttgatctcctttagtttaaaatgagataagataagatacactccagcatcatgctcttacttaaactgagctgattctcttgatttctatttcttgctttcctcgccattggcctgaaatgagtaggcatgacaatttttgtccatatgttgtatgtaattaaactccagcctttacattgccaccatcaaagacagcgaggaagagacattttattattgcaattcactgtcttaaggtggaagcttctgcaacggtgacacagaagcgtgatggagaaggcacaaaaatgatccatcttgctcttttaagagaggagaacataccggacttgtgcagacagaacttttttttttttttctattgaagcatcttctagtgcatttaagcttttttcttgtcaacttgaggatggagtgaagaaataacacacacagcttgtttgacagtgtggctattaatgaagcaagcaacaacagctttcactcatgcacaacagggcttggctgtgtggtttgcaaaaagcgatgaacattttcacattaggattttgaaggggctggtgaggaaactaaagatcatcagcatttgcgtgtgaaaataaaatggaaacgttaagaaaggttgaatgtagccttcaaaagggggtagaaagaacaaaatgaaataagagttgctctggtttgaatgtatgtgtccccccaaaattcatatggtggaacctaaaacccaatgtgataggactgagcagtggggccactaaggaaatgattacatcatgagcactctgcttccatggatgagatgagtgctttatttttgttttgttttgagacagtgtctcactctgtcacccaagctggagtgcagtggtgcaatcatggctcactgcaacctccacctcctgggctaagcaatcctccagcctcagcctcccaggtagctgtgactgcaggtgtgcaccaccacacctggctaatttttgtatttttcgtagagatgggatcttgctatgctgccacgctggcctggagctcctggactcaagcgatcccctcaccttggcctcccaaagtgctaggattataggcatgacctaccatgccaggtggattagtggtcttaaaaaagaggttgaatagtggctcatgcctgtaatcatagcactttggaaagtcaaagcaggaggatcacttgcatccaggagttcatgaccagtattggcaacatggcaaaatcctgtctctacaaaaattaaaaaaaaagaaaaaaattagccagacatggtggtgcacacctgtagtcctagccacttgggaggctgaggtggtaggatggcttgatcccaggaggtcaaggctgtaatgagccgtgattgtgccactgtgctccagcctgggtgacagagtgagaccctgtctcaaaaaaaaaaaaaagagagacagattgaagggagcacaatagcaccttttgcccttctcccatgtaaaggtgcagctatagggtgacattttagaagcagagaggaagccttgcctagacaccaaatctgtctgtgccttgatgttggacttcccagcctttagaactgagagaaataattttatgttatttctaaatgacctggtctcttgtgttttgttatagcagcacatgtggactaagacaagcatgatattttaggttccttaagcagggtagagaagagagtcagaatcctaatatgtctagttgctgtcaagatgggtgcatgagtgtggcacgctgtggactgtgcactgcaagaaagcaggctccattttctctctccttctctggctgcttcggaatctccctaagctagctagtgattacctagtacaaatacgcatttccagacgtatctccctgtctagactgagagtatctccacagctgagggggtatccttaacccctggtggaaaatctggtacttagtaagtgtggcaggcagagtaatggcccctaaagatgtgcgtgtcctaatttctggaaggtgaatatttcaccttacatggcaaaaaggattttgcagatgtgattaagaatctggagatgtgattaccatgaatcacctggatgggcccggtgttgttcaagggtcattataagtgaaagtcagagtcaggagagtcaagttcagcatgatgagatgtgaggaaaactccgccaggcactgctgactttgaggatggaggaagcagccatgaaccaagaaacagggatggcctctaagagctggaaaacacaaaacacactttctcctcgagccttcagaaggagcacagtcctgccaacaccttgattttagtccagtgagatccatttaggattttgatctctaaagcatgaggtaacaaatttgtgttattttgtgccaccaggtttgcagtgatttgttaccgcagctgtaaaaatttagtgcagtgaacaatcaaaatcgaacagcctcttgcttcacatgtgccatgtgctgacatcaaagaggtgctgagaaagtactgctattgattttgtactagcaccagaaagcagagagcatgcttctaggactcaacctagagctccatttctatgctcttgataaacaacttccatctgcatatttgggtccatttccctgatagccaatatgatttttaaaggaaaacaaaaatatttttaccagacagtaatatcgtattggtgattgggttaaaaagctaacagtttttcatgtatgtaatgggtgtgaggtttttctttttttcttttttctttttctttttgagatggaatctcaatctgtcacccaggctggagtgcaatagtgtggtctcggctcactgcaacctccgcctcctgggttcaagcaattctcctcccttagcctcccgagtagctgggattacaggtgcccgccacaatgcctggctagtttttatagttttagtagagatggggtttcaccatgttgcccaggctggtcttgaactcctgacctcatgatctgcctgccttggcctcccaaagtgctgggattacaggcgtgagccactgcgcctggccaggtatgagttttaatccacaaagacggcatggttagaattgaagttgtatttttgtatagttcaacttaatttgtaacatatactgcatgatgccaggtggtagaatcttaatttcatttaattcacgatgatcacagtcaacgcggggtcttctccactctgtgtctgggtgctttcctctgtgtttaggagtctaacctggggctaaaggatctcagcagaccaagtagagagggtgtggccttctttccatcactgataccaattcacggccggcatctgcagctaccaagtttccatcattgagtcagattgcctctggcctcttgtgtccttaactattaatataaagcctctccacaaaaggctctttcaacaacatctatggccttgtgagacaccctgaaaatgcctggctgtggaccaccctctccagaggtggaggaactctcttaggctgttgtaggaccatccacctgggcacatcaaagcagccatcttttttctactgctccaagaccgtgtcgttaacaggaacccatgtggaaatgttggactgtgttggagtttcctgagaccaccccttgggttgatgatttgctggagagactcacagaactctgaaaagctattgttgttaaggttatagtttatgaaacagtgaaaggatacagattaaaatcagcaaaggaaaaagtgcataggaaggagtccaggaaagaccaggcacaggcttccagttgtctttcccggagacctatagggacagggcttaactcttccagtaagaagttgtgacaacacatacagagtatcatcaaccagggagctcatacaagccttggtgtccagggttttcattaggggttagtcacatagagtgctcagatgacttaccttaacacttgagtctccaacccctcctccagaggttcaactgacacagcgtggcccagggtcccagaagaataaaaacagacactcgtcataatccaattgttggcataaacaatcttgcctggccccaagcctcaggtctgtaatgacacttttatcaggctggaaattgcaacagcttagaggttacctcctaggagtcagtcaagggcaagatctttctttagaatgtgtgggatttggaccccctaagcctgtgggattaaccctttactgcacacaggcctagattccctgggctctcagctaagcccaaagccatgtgtggtttccactgtgtctcctcccattggatgtgcctcctgtggataggtccttgactcagggcttctctgctgttagccatgggctcgttattcagtctgggtggaaaaaaatggttctggctgatcacatagcttttggcatctgttgttcatgtcatcaactaaatgacatgacacagagattaggcttttgaagctcaaagcaggattcttatagctagaagttgtttttttttttttttgttgttgttgttgttttcaaatttccaaccttaattttaacttcaggggcacatgtgcaggatgtgcaggtttgttacataggtaaacaggtaccacggtggtttgccgcacagatcattccgtgacccaggtattaagccccacatccatcagctattcttcctgatcctctccttccctccacccccacccttcaacaggccccagtgtgtgttgttcccctccatgtgtccatgtgttctcaccagctaaaagtaacttgactttctcactcctttataatcttttaccttttcccctgagaaaagaatgccaccaactaaatggggaagtatggccctagagaacagtgctgaggtcagcaggtggggccagcagagaaaaaggtgggggggctgacctcttttgtgcctgtcccttattaaggaggaaatcctttcccagaagtcaccaacagattttaaaaaatgtctttatctcattgaagttgggtcccacttagactaattcctggcagaagaaactgattttggtgtatttgacttaaagcaaacataatgtattccctaaaactgagtatatatccatcagaacaaaaccaagatatttcttgagcaatcagtcaacagtgttggctataatatgcatgtaagatataagactctgcagccttgtaaagctgcggtgaaactgagtttccaacaggtcagagagtgacgaaattgcagtagctctactccagggactccacagcactctttaggttgggaaaagcaagtgagttgcttttacaggtgtaaatcagagggatggaaattattgatgagataatcgagatgggatatgagcaggtattcagaatatatacggtttgcaaatgagaatgaagacttcccaatccttggagcagttcataaaggtatgtcaaagcctgcaggagcctaaggaagaatgtgctaacttttgaaccatgtagatggctcataagaaatataaatattgaatacacttttgctgctattagtggctgccttcatagttgtgctcagtaatttgcctgaagaccctcaagccttgcggtgttaaacattgtgattcaaaacccaaatctagccaaggccgtccatgtgttagatgcttctccaccccaggagacagggcctggagttggtctgtgtgcttggagctcatgaggcaatgacctgagctgcaaatcttcagctgtgcacccacaaagctgccccagaatcctagccatagtgtttcaggccagacctcaacttttcctcggatcatgggttatactccagattttgaactggacagctggacaacctttaggaaccctcccctagaactgggaaaactcctaaaccaagctcctgcctgacccactctccaggctccacctttcccctcttctttatttgtttatgatggagtcttgctctgtcgcccaggcttgagtgcagtggtgcgatctcagctctctgcaacctccgcctcccaggttcaaccaattcttctgcctcagcctcctgagtagctgggactaaaggcgcacaccaccacgcctggctaattttttgtattttagtagagatggggtttcatcatattggccaggctggtcttgaactactgacctcatgatccgcccgccttggcctcccaaagtgctgggattacaggcgtgagccacagtgcccagcctccccacttctttattaatgaagacagatgtcccagctcaagaaaagagagtggaaaaactcctccttcttctgcctttctgttctatccgggctctgaaagaactggacgacgccagcccacgtggctgaagacaatcttctttactcagttcactgattcaaatgttaatctcttctgaaaacactttcacagacacacccagaaataatgtttaaccagttatctgggcatctcttaacccagtcaagttgacacataaaattaacccatcacaatgtcattgatgaaaattgcctaaatacctccacccttgtgaaattgataactaccttgtctaaccacttagttaatgataagtggaaatgttgcctctacatcatgcaaaatgtgacagatagggaataaatgcttagagatgcttggatgaaataaagccttgtccagatgaagaggtttttgttttgggcatttgaccttgggaagcagttcaattaaaaaaagaaaaaaaaagtccccgtcagtgattttatagcacctggtaaaattgcaagtgattgctcacttctcccctgctccttcacccctgcaataagctttgttgtcggtcacagccttatgacctcctctgtgctgctcatctcacagagagtgtggagcaccctggaagtgagactcaaggccaccagccttctgcaatctccaggtctgtacctggagcaaactctactctgtctctctctctctccaagtttccttgcagaaggcactgctgacagaataggtgagacaaaatatagtgaaaagaggagctggtgccatccaatccagagagacaactacctggcctgcagtgccctgggcttgctggcatagctgggctcaactgaacctttcctgcacaacatctctattttgtgacctcactgtggcacactcacctctcaaagcgcttctgagacctcccctaatgtgaactaccttggcatgtttttttccacccctgcatattattgtttgtgtgtcactgttctcattgccagggcattgcattgggatttctttgtcagagcacataaagaggcgtatccagaataggtatccagccagcataaaacaatgtggcataatgtgttgctaaagtatatatattttaaattcttctgtagtagttggtaatcagaaatagtttacttgagaccacgcattatctaatgacgttggcccatggaggctgtggtggtggtgtggtcttgggagtggggctgtcttggaggtggacagaggtggaggttccaggtgggatgtgtgcaatgcctcctgctgctctggagtgggccagaggtggcagggacaacccaacagggtgggggctgaggctaaccttgaggaattggggttgggaccaagacaatggtcttttaagttcaagctagctgaaaagtgctggcttctgggtgatgcccagcccagacaccttcttttgtaaccagatgtagtgcactggcctgatgactattagcttaatgggaggtcaataaagtgtgtgaggctaaatcacagtgatgcagaatttttctcagccactttgccaacaagagacctccatggctggcgatatccccctgcctgggccttgctcagccccgggcctgccattggaggcacccccacccgctgagcttgctgtcctatagcttgtacccatgtttggcagttcccgagctcctgtcccgtgtccaagaagaatgaggatacactgacaattccaagggtgaggatgggcagagaagaattgtattgagtgatggaacagctatcagtggagaggggatacagtgggtggtcccccaacccctcagttgggttgtttatctcccagtgtggctaggtctggagctttttatggactcaaaatggagagtgtgtgctgattggtttatgagtgtgcaaaaaaggttaaaatgaagacaccactcaaaggcacgacagtgtagaaaactaattaggaaaggataggtatatgtaaaatagatgaagggtggggatcaatcagagaaaagtgcaccaaaatggaaagacaggttctcaatccagtctgtggatgtacccaggacttatagctaggctttaaactgtcttcggcttgaaggttgggtttcaatggggacccaccactgtctgcctagggatttgtctgtctcctgccactatcaacagctcagccacggacgtcagcttgggacatctgcccaaacgagagatcaccctagcaattcctaaaatcagaagtgtcaggacagttgggtaaacaatgctatagcttcagaaacttgctgagcagtgtgtgagtgtgtgtgtgtgtgtgtgtgtgtgtgtgtgtacagggatatgtatgaaattagaggaaagtttttaattactaatttatgtatttgtgcaggttgttgaattattttagtatcaccccagatatacatgcagcacagcagttattgaatcttttcagttactgagtcttttattttacttttccaaattttgcaagtatgtgaactacaactgctttctttctctatttatttgttttcttgctactcggtgcatgtgctgttgcatgcaccaagttaattcattttatttccctaacaaatgtcagtatctctccctccccctatgcagcacatcattgcccactcagcgtcactgtttggcacattcaatgtggaagacacatgggtgaatcattcccagcatctggacatttagagtcagctggatgctgttgggtgtcttatttttcatgcagatgtgaggcattatataaagcagccacatttgtattaatgttgaaaggtcctagggtttctgcattatgaaatgaaaaatagctattagctactattatctgatgaggtttgaaggtatgtagttctagaaggaatattttgaatggacataatttctcaaataatatatagtttttatcctaactacaccaaagattttgtcttataactgtgctagcactattaaatttttgtcctatcactagaaattttgctattttagacaagagaacctgactttggactatgatttatgtaatggaatttcgagtggtccattaaacttatttaataaccataaaaactggcataaaattagccataattcatcaaatcttacattatattcttagtctgggattgatgtttaatcagattttttattgtttcataacatttaatgggctatttataattattttctcaactatatctgatggaaaaatatattacagaagagtttttaatgttccagaaataaggatataaatatacaaacagtgctcacccacacaggaactaaggcaaagattgttgctgttataatttcagagcaaatcgattggcctttgtaagctatgattagtgtagacatcctaataacagcgtgtggtgaatgctggtcttctgaactttaacaactcctccaattcggccaccaataaagtgatgataataggactgaaaaacttgttctcacagtgataaatttgcatagccccatgcatatttgtggcttgaatttttcctccttcaaaatcccagagcaaaatttgaacaactttgtgtctttatgatgttataaattcttggcaagaaagtatagagtgatggcagagagcaaagcgaaactttagaagagaatattggcagaaacccttggagactggtcccgagctgtgtgtgcaagtggatgcattcatgcatgcagggcatggaggctctcagctgtgatgggacccaagagatggtccagggcccctggagggcctggaagagattggaaacaagagtcgagagtgttccctggcagctgagcaaggccagtcagcctcactgaaattcaactgcacaccagctttctacttaatatgttaattttgtgttccattttctcctgcaatcctttctgccagccactcttcgcttttacatgcttcatgttggaagtcattatttctgtcatctctaaatatttcatccaaggaagaaaagctaggatatgtctagagaacagaaactaagtttgtaggaagtttggtgggcaacacgatggactccagatcagtcaatgccacgtgagttctctttgctaacaagaaatcagtgctcatggtatcaggtgaacagccccccttttttttttttttttttgacagagtctctcactctgttgcccaggctggagtgcaatggcaagctctcagctcactgcaacctccacctcctggggtcaagcctcctgcctcagcctcccaagtagttgagactacaggtgcatgccaccacacccagctaatttttgtatttttagtaaagacagggtttcaccatgttggccaggatggtctcgatctcttgatctcatgatccacctgccttggcctcccaaagtgctaggattgcagccaggagccacttcttttagtgattttcaggattaatttctaggccttatgttccaccctgtgtctttcttttcaatcctagtttcacagcctgctcccttcatcggctcaaacttcatggtggtactttatctcctccaccgcctccaagaacggtatcttttcatttagtgcagttaattttataggctaaaggctctaaggttctaatacttgtattgtttttcactctgcacccattgtattttatagaggaaatatttttgatgtcccaagacagtttaaataatttattgttttggaatattccctggacacaacaaaatactttttgctcaatttttccatttttctaaattgaaatgaatttagaagtgaatatggtaaaataattgtataataaccacttgattttttagacccatgacctaatatcatcaaaacacatcacagtgttttgtgaattacaggagtatttacctcagatagagaattggattgtgcatttctaacataaaacatgaagaggggcaccgtgtatgcctgcctgattgctatgagatttaggaatcgtcctacctattcttctcatactacttatagttataagtctttactaaatagtggatgcctactaaaaaaaaaactgaattaaagcatcacatgattccacaaatatggatcagttccaattttcactattttaccctaattcaattaacagccttctacagtccagctgaatttcatctttatgtatcatcatctctaataaaacatttttactcttggttcatgatttatactgctctttatcggatactttacattcagttattgcatctctgtggtttcggatgcctgtgtagcatactcaatcatcaaaactgtaagaaacagggctgattgttatttctatgctcaagaacattttctttaattgctgtggctttcaggacatcaaacaaccaccacagaaggaagggaaaggaaatattagggagaaaggatgcaagaagagagtacgttaattattctcaaaagagcccatcatgctctttctaggctgtgctaggaaagtgtcctagattggcagcccccggtatgtgtatgcttctgtggccaaaacctgaagctggaataaaatgaagtgtttttttcttgaatctttacttgcaaaatttggtagaagggtatgagtgcttggctttagtaacttgaaaacaatttttaaaatttggcagttgtattttgaaactgttttaaaaagaagaatgactatatatctcctcagattttagggatggaacgttttgactgtgagttgtccaggttcttggtgcattgagcaaagaactaaacaaaatccacaaaaaatgcaacaaggaatgaagcaatgaacgaagtaacaaaagtccagctttactgaagtgaaagtacactctacagagtgggagcaggctcaagcaagcagctcaagagccccgaatgcaatgttctttagggtttctattaagctaaaagaatttggtaacacccctaggtgccctttcgaggcctccagttagtcacaccctatgaaagattggcccaccaccaatcagaggctgaagtgaagacttggcccacagtggaccagaggctgaggtggaaactactgttttgccatcacaggagtgagggcatggcctgtgtgctaatctttcctagaactggccgaacctgctgttttcttgcttatgccttaacccttggttaccctaaaccctattctcctgcctcaccattggttagctatccattttctattttcactcactctgatgagggtcccaactacagataaaccacttgactcaccaaacactgcttgctgaagtgagaaatgtcataaagttatctgagtttggctttgtactcttttatttgaaagagcgtgttcatccattaacccatccattcagaaagcatttattaagcacctgctgtgtgctggctttgctcactctgccaagctgtgaaatctgtttctctaggcggagttctgaagtcacccacattctgaatctcagtcttggaccaactgaattagaatgtctgggctggggcttgggaagttgggagtttaacaagatctgccatggtttttatgcatggtgagcctgctggtctcaattgaacaaatgtggatggaatgaagcatggattagtctgttcaggctgccgtaacaaaatccacagactgggtaacaaaaacaacataaatgtattttcacacattctggaggctggaagtccaagactaagtgttggcaagtttggcctctccttggcttgcaggtagctgcatactcattgtgtgctcacatggtgtttcctctgtgcacacatccctggtatctctgtgtgtggccaaccttcttatgaggacaccagtcattggattagggctcactttaacagcctcattctaacttgaagactctgtctacaaatctgattctactgggactgagggcttcaatatatgaattttgttggtgagacaccattcagccaacagcaaagcaaaagagtccactcttggccggcatcccaaattagttgaacctctgccatctcaagccagagctttgcagtccactctgaaattggtgggtgacctgtggaggtagtttctcccctgagagcttctcagtgcacagttaaggctctgaagtcctcctgagcagctcgcgaaactgaatttaaaccaaagttttctacaataatttcaccatgaccctctgatgtttgcaaaatttctgttctcaaacaggttgctcacttgtaaaatatgttgtttctccaagctagagaaaataaaacaagaagaagtcaggccccttcctgaaggccacccaaatgtgacttagagatgagatatcaatctgtcttactcagttcaagacagtaggaaaaacattgtgtatttacaggcagtagccatcagacagatcttattcctacatatctgagctgcactctggaattttatcatattaatctctagtgtctcttcatctacccaccccgccactcatccctctaatagaaaacagttttagttcactccagagactgcagcaggtgccaggagcctgaaacacacagcagccccagcctatgtatcccagagccctgagtccaggctctatgctcttatcaaagcaaatacagagcccatcactgggtctcctgggaggccctctgccctggtgattctcattctcatcacacatcagaatcacaggaggctgtaatctttgagaggccaaggtgagccaattgcttgaactcaggagttcaagaccagcctgggcaacatggcagaacccccaactctactaaaaaaataaaataaaaattagctgggcatggtggcaagcacctgtggtcccagctactttgggtggctagggtgggaggatggcttgagcctgggaggtgaaggttgcagtgagttgaaatcacaccactgcactcaagcctggatgaaagagcaagaccttgtctcaaaatcatttttaaaaaaatgaaaatagaattacaggagagcttgtgaagaggcagatccctggacttcattcctcacctctggaaccaaaaactcctgtaactgggggcagaaaaatttctctttttggaagctctccaggtgattctagttctaaaccatggctctttccggtgtaatttctcagtactcctaatgggtgcttttaactatgacctagatcagctgctccctcttgcttgtgctggatacatacttatcgtgcctctgttccagccatgtcaccctgctgtgctctccgcctccagtgtttcttcattctttagactagcacctgcccctcttcaccagggaagcctgcatcatgaggaacaccagtattgaagtcttcatctctgtgttccttcagggctgtggagtccaacagccagggcccagctgtgccagtacaagatgtatcaccctggacaaatatttaccctctctgagccttgattttcccatcccaatccacaacaggaatacatgaatataatctttgtttttttttttttttttgagacagagtctctgtcacccaggcagagtgcaatggcgcaatctcagctcactggaacctctgcctcccgggttcaaacaattctcctgcctcggtctaccgagtagctgggattacaggcactggccaccatgcccagctaatttttgtatttttagtagagacggggtttcaccatgttggccagggtggtctcgaactcctgacctcgtgatccacccgcctcggcctccccgtagtgctgggattacaggcatgatgagtgtaaactttgaaatacatattaacttggcttttatcagtgtgtagtaaggctctccatgtcagagtaaataaatccaccaaataggagtcaaataaattcttatctgaaaatccaagccttaagattaggatattctagaacttctcttctagatattttcaatcatgttgaatctcttgtgttacatatttaagagaaggagaaaagaaagcttcttttgaaagcctgtgaccaaaagaaagaactggaaccagcaaaagcaaattggtttgttttcactcaaataaccgtctgcttgacttaaatgtgatctggcaaatgggcattgctacaggaaacaaaaggcttcttttgagcttctagagaaagagaaagcatcctgaatacttaatcaagataccttttcctacaattagtggaaaccagctcatgtctgttttctctcgccccgtttccttgtataacactcatctagctgcttccgtgaggtagatttaaacgtccaccacccagaccacacccatggggccaccaacattctagagcagcttgctctgtgcatcttatccacactgccatgcgctctgtttatctcattagaaaaacccttgcatatttactaaaggcaagaggcaaaataaacgctgagttacatatgtaaaattccatgcagcatcgttctcctatgtattactaggtttggttattttacatgaagacagtttctttttacacaaacagtagggctcttatgcagttgttctctttcaacatgaacacaatagactagataatgttgtctgtttatatttctttccgaaagtaggaataatttcctaaattgctttcacgtactgtgtaaaacaccgtagaagttctgaggcttatctgacatctcattgtcccctggtgtgtgtgtgcgtgtggtgtttttgtgtgtgtggggtgtgagtgtggcagagaggaaaggggagctgtttgattctgtagttccttttctgccttcttcctttctctgtaaactttggatacttatccaaattactaacggcagattgagccctatgcagatggcatgtgtctgtgacaacctctgctctccacatctcttgggcctgtttacctgcgctcccagagcctccgccagcatcccagaatctccatccccatctctcacttatacacacatcagtcatcggttatccattagctaaaccgccttccttaatagctttacactgtttgctttctctggaacatttttagttaaaatttcataatgcagttgcacacaaatgaagacacagatggctgcatcctccgtctcttcccctcgtttacaggaagctgcggatcagggaggggtgttagggttacccacatggtaagggcagagacaagaggggaccccagttttccatgctgcacatggtcattgctggggactgaggtttgcacatcaccctgccctgttctccctccgctggggagaaagtcagggatggagcaagctgcagcatcttctgaaaaagaaaaggtggccttgtctccaggtctcccctcaagtcccaccttcccatagttttctgccacttctcttgattttcctctctgccacttctcttgattttcctctctgcagctgctttgaggtgggttttctccagatgcacactttcccctgctttgcgtccttattctggtagaagcacaatctaaagctcattaagggaactaatcaattctgtgcatggcgctagctcagcagatcaccacacaggcagcactattagcaagtcggtgcttaacacatggcacttccatgaatcgatatggagcccgtgtagaacaaggcatgggtttttttctcctcccattaagaaaaactgatgccaaaaataacttctcagatattttcaagtatgacttttatggagggaaaaagcatttttgtttgcaaaatcatgcttcaatgcaggccagttgtgaattgtgatggcttttatttctcctggggctgtaactttaagggtttagaatttggaaccacagcctagctaatcatgacacacacacacacacacacatgcacacacatacacatacacaaagcatcacgaagaaccatacaaattgtacattattttacacatggaggctcactctaaaatagataccattttaaatattaactaaaacttgtgctcattgtatgttcattctatatgtactgatttgttattcacatttctttcaaaatcgttcaaatttctagcccacatcaattaaatattaatagtactttctacaaacatgagcgcacaaaataaattcaaatctatttttcccactggtgttatcagtactgctcatactttgtcagtatctaagtatcacatgatcttaaaactaatgtcacatactaaaaagcttctgaggcaaattgtagaaagaactctcaacatcattgttctactggacaacatacataaaattattttacagtgatgggagagaaataggctcctcatcctaaaagctgcgaagacagtagcggtgccgtgttttggcgttactcccctgtggatcccagcgacgggtggatttctcctgtgctttatcatcagacacaaaatggaccaaaatggaccaaaatggacgagtgtgagggacacagaggctgctgtaaaaaaaaaaaaaatgcaggatatttatgggtctatgacgacccaaataatgagcaaacatgggaatcccctgctgaaaagctgtcacagaactgaagcctgcctggaaatatcttgagaatgttgatatcattttaataggatctaaaatgagaattctatcaatataaaacagggagaagggcctccttctatttttaaaaatacccaacattcatgtttttcatattttcctagcctataattactcttaatcaaagcacaacaaatagtaaacagtaaaaatgaaataaatgtggtgacagtttgccaataacgaggagaaaatgtcccatctgtctagccgcgagtaaaatgggtgtaattaccgctcatttttctcgtaattgctgagttattagtttaaagcttacacacaactggtgaacagtgagtactacccattccgtaattacagccccagcctcgccgtgcttgaaatcagggaatgcaagagcagaggaaacgatctgaattaaccctgactgcttgcacagaattgtgactgtctatcttatatttaaattttataaactctgagttcctttgctatccaaatgttaaactggaatgtttgcaaatccagcttgaattctaatttgcttttaagctatagtcttgcatctgcttctaatggtgaatgcataaattcatttttgatagaaataatccatgcagaccaccaccctttgcattgcatttgttaaagttatgcatggttcactgatatgcaggggtctgttagcagttatgttaccatctcgttaccagggaaattccatttgaaagtttaggattacacatgggtagtcaacacctgacgtacacagcagggcaaatacagaaaaaagaatctcccttgattgtttctgtttattacaaatcaaagattaagacaaatagagctgtggtttatttcttcttccagtatgttattttatctctgagattcacctaagaaagactaagttctatgatgttctcatagaactatagctacttttgcctaaaatgctgatatcattttaataggatctaaaatgagaattctatcaatataaaatgggggccgggcatggtggctcatgcctgtaatcccagcactttgggaggtcgaggtgggtggatcacctgaggtcaggagttcaagacctgcctgaccaatatggtgaaaccccatctctacggggttttttgtaaaactacaaaaattagccaggcgtggtggtgcgcacctgtagtcccagctacttgagaggctgagacaggagaattgcttgaacctgggagacaaaggttgcagtgagccaacatcatgccattgcactccagcctggctgacagagtgagactctgtctccaaaacagaaaaagaaaaaaatttatatatatatatatagatatatatttatatatatttatatatgtatatatttatatatatttatatatatatttatatatgtatatatttatatatatttatatatgtatatatttatatatatgtatatatgtatatatttatatatatttatatatttatatatatttatatatttttatatatttatatatatttatatatatttgtatatatttatatatatatttatatttatatatttatatatatatttatatttatatatatttatatatatatttatatttatatatatttatatatatatttatatttatatatatttttatatatatttatatttatatatatttatatatatatttatatttatatatatttatatatatatatttatatttatatatatttatatatatatttatatttatatatatatatttatatttatatatatttatatatatatttatatttatatatatttatatatatatttatatttatatatatttatatatatatttatatatttatatatatatatatatatatgaatgagaagggcctccttctatttttgaaaaatacccaacctttatgtttttcatattttcacattctagcaaaggtagattttctgggttacctctctttggggtcctgtctttggtctatacagggaactgtaactcaccacagacagagatagtgctgagatgacaaagctgggcttgattccgcttggatccctggcttctcagccattcctgatgaaccttttattagctgcctgtctctgatccgggaacactgatgacaggtgcgtttattttgagggagcatatcctcaagctatggagtggttgttgaatgagatgttgtgaaaaaaaaaaaaaaaaagtcatgagacccccggccaaaatcctcagactagcgtggcattttttttttcctagcaagttatgtcatttaatttatagatatagaagtggagacaatgaaaatatagcatagtatgttcatttccttcctctgagcctgagtgatgccaaggcatatttttctatgttagagggactaccctggaaaaaggaatggttatagtaaaatttggtatggaagattcactgatacgaatctcacattttcggaaagagaggagatgaggaaaggacttggtgatgatcaaatataacctaagaatcaaagttatttccattcctggctgcagaagcagtgaaccacccccttccttcttccctctctttctttctctctctctccctctctctctaatatttaacctcttggttgagataagctggtgaaaatcatggaaatgtatttttaaaatcttcattctaagcccccgagaaccacagtatgccagattcctttgagctccgcataaatgtcttggctccgtgaaccacgtgcatcttatgcataatcctttggttgtgcgcgccagctgggcagcagagatagcgagtgctggggtcttgcagctttaaaactgtgcccaggcctcactcagaagtaggaaaatgaaatgagcatttgcataatctatctcgagttacccaggtttctttcaatcttcttatcacgtttttaaaaaaatctattaagagaatattagaacaaaatgcatttttctcttcagagaattcattttgcctgcgtgtttgggtcctatagggcttttcatttgttttagttttttaaaatgccttaagaaaaatttttaggagtttactttgttcctactcttctctatttgagtcagcaacacatatttagattaattcttttgacttggaagtgcagttctgagcgattacaaaatttttatctaaaaaggctctaaatgaattgaagttgtgaaaattgtgataatttatttcctggaattgaaatacagagagaaactaaaatacacaccacattttaattcagtgttaatttctcccatttgcttataaaagaaaacatggtgcagatcttgtgtacttgaaataactgtccacacattctcaatccacagtcacgaatcagacacacacacatgcacacacatgcacacacacctgcccacgcacacaccggcatacactgctaaagtaacaagcttgctctccaggcctgtgctgccaaggctggctggccagactgcctgcctccctctctctttctttcttaactagattattttcattaactctactttctaaatctttctttacctcggtagcaatttgcagctgcatcatttactgacacgtgtttcttgaagttccctagcaggcactgagttttgaaatccagcggtctccagtgtctggcccgcacaccagcatttggtactgctgccctgtccttttccctcctgctgacatccctccctccaggctgtctgctgtgtgtcttcgctttctcttctttattttcccctttctctcctgtcgatgggatttcccttctttcttctgccttgtctgtcccctctctgtgtcccttcttccttgaatggtgacctacctctctacaggctgttcccagatgccgtcattctttcatttaacacagaagtactaagaactcatctgtacctggtgctattccaggggctggaagactacagaaaattttagagagacaaaattcctatctttgtgaaacttatattccagtgggagcaggcagacaactactaaaataaacatgtaacatgctatgtttgatgaaaagtgttgtagagaaaaataactcaaggaagggtgatagtaggttgaggctgtttaatgctttaaacaggatggttggtgaaggtttctgagaggtggacgtgggtgcaaagacaccctttcttctcgctcagttattaccaaaacggaaaaatcaccacgtgcctgtgctgaagacaaccttgtagatacacaggcttcaaatgaatacactgaagttcacacatttctttaacctgggatgtcccaaatatttctttttagatttgtacatattttgttttactgatagcttatttgatgtattaagatactattacagagaacaggaatttctagggcatattgggaatgaaaagtatggccatcgtgttgcatctgagctgtgggtccccatagaaatgtgaagagatgagggaaaaggataaatctttggaggaagagtgttgtaggcaaacagaaccgtaagtgcacaagtgggagtgtagtaccactgcatgctggtagaagccttggtagtgaagagctgagtggggaaacacggttccgtcacaaagtccctctgtgtgcagacagaggctgatgccagctctatgcctactgccaaccgctgccaccaaaaattacggacagaacaagaggaacaaaagccacagagctggtctgaatctcattcctgaaacatctttcctcttattgttttcaaactttctgtgttttgaaagttcttaaatgtaactcttgtgcttttactcctccattaaccgttcatcaagtcgtctttcaataaagagacttatatgttgtgtctttgagattcctttatattgggatataaaggagcatatcccactaaggaataaatagctgctaggctttctctttctttctatttgttaggctatgttcctgggtcgagaataagaaatagtaaaccctttgtgtcctccctttgggagaagaccaccttatacagcaacaacatgggatctctggggcgcatcattccctgggaggcttcccaatctaataggagactgcctccctttgggaaaagacaaccttgtgttttctgtgtatggttcattccaagttacacacatccaagcatcttacaccattgaacacgctctcaaaattcactccaggcatttgcgttttgactccatgcatccccatcaaacagttcttagcctacagtcctgacggaggcccatctgagcagccatcttattctcaatgtctagctaacccctcctttcttctcactcagttattgccaaaatagaaaaatcgccatgtgcacgtactgtacgtggctgtggatacacaggcttcaaatgaatacattgaagttaacacattctttaatgtgggatgtcccaaatatttctttttaaatttgtacatattttgttttactaatagtttatttgatttattaagatgctatttactgagaacagcaatttctaggacatattgggaacgaagagtatagccatcttgttttatctgagctgtgggtccctgctcttgcagagagatgtggaactgggtcttgctgtgagatcttgtgaagtcaccgccttcctctcaggaccaccgccatttgattatacgttgtgtgcattccttcacgtgaccatgtgccagatgcaatagaaaaagtcgtttcagactgccactctctgcttccaaaacccaagtatcacattggttggaatcgatgaaagtaactgtcacccagcatttgtgttcgctggtgatgatgtattaaatagggaagaaccacaggctgggaggacatcagtaaacaacctaaagggggttttaaatagcaaatcaatatggaacaacggatgtagaaaattaccaggaaatggataattaagttcctgccatgctcttttacaaaatctctgagaataaattctcttaggacaaataaagaggaaaagtgatgcccatgaaaaccttaaggaaatgattgagtgttggtgcttaaagtgatggagtatcggtggtgtcatagtgtgcaaagggaacccacagcctcttgaagggattcgcacatggtcacgtccatctttccattccagtggcgctgggcttcctgtggatgcagcacagttaagtgtagtggtctttctaaaagcaccgcacaggtgcttgtcaatcaacgtggaatgaaagccaccggcctagggatgaagagtgagtgagacctcttgcattttccgactaagcaatttcagtgctgtcgtgtgatcttgttattccaataagcaaaacacgttattttattttgggctcagtgttggatatactgaaaacaatgataataaccagcatttactatggagcacatactgtgtcccaggaactgtcgtgtcctttatatgttttacctcgttactgagtgtgtgtgtaaaacagctctttattatgtgagcagaacaactccccaatatatgtgtgatagtagtgtgtcttttaatacatttgtgtatgcatatgtatatataaaacaactgtcctctcaccctccccccacccaatttccttttattcttgtaaacgactttctctacctcttcatttttttatttacagaatgacaagtattcataaagccaggtataggcagattctatcagttggctacaatagctggatttgtcttgggggtagttttatttattattttgccctcctatttctgacaggctcatgaacccctgagcactggggtcagcatagacctggtcagcagccttggaagccagcatagctctttggaggccccatgcccagggcactacccttgcaaactcagagctgtaaaaggatgccctcttcaactgcgtggacgcgtgctgttcaaatgcaccttctcacagaacctgtgcagtagcgcagggaggcagactttgtcagaattgtacccacattttactaggaaagcaccaacatgcagacagtctgaagaacttgcccatggtggcgaggatagtgtcaaagccatggcctctgttgccatcaccctttatttttccttctgcaccacaagcccatgtctcctgatatgactgggaagcctcatggggagtgaggttccccacagagatcagatgtgttgctgtataacttcctactttgggacagagataaaatggatgacttctttggccctcccagtcctgagattctatcatccagattcattccagtaaacatggaacaccacctaaatgtgctggagtgaacagagtgattgtttccatgactgatttcagtgtcttaattccttctcaccaattccatgactgtggggcctgagggacaggacaaaagagtagacccaatactgggaagtcttattgggttgcaggggtgctctgagtcagctggaggaaaacggtgaatcacccatgcaagcccagaatcccacccaaaaccatgcccagaattcagacacattttattttaaagaaataacaaaagtggttgaatgaggcaagatgtgggagtgaaagactggacctgatggtgacagctagggaaaggaatctgagctgctagagcagttcagtagctggctcaattatcaagcggtgagatttgctggcaagagtcaaataaggaacaagaagacaaatgacatggggcagatagagctgcactgtggcagagctgatctgcaggctggtggagcagaggaggggagccactgagccatgcagagaggccacgtataagataatacgaagtgacttggccaaaatgtgtaagcacagaaggttcattgctggcatacacaatttctgctacataacatggtgtccttaatggccataactgctgaaaagcacagggagaaagtggatgttatctaatttataaaatgataatacttttattatccagattgatgacagatgctccaacccccagagtctttctctccttggccccttgacctgaattcttcaagcggggacttcgtttcatagcctctgagcccattctttcttcccccaactccctcaaaaatcaaattacattgtaatgatctgtccacctttgggtgacactctaccgtgttcatctgagactctctccagcgtttttgtttgtgtccaggcttccaggaaagctgatggggtctacatgcacttttcctatatcccccactgacaagtacagtgaaggccgaatgctcagtgaacagtaactctctgccctaaatccaggtgggtgatggatcaacactgaacttttatttatttatttttttagaatatattactttggctgggcgcagtggctcacgcctgtaatcccagcacactgggaggccgaggagggagaatcacttgaggtcaggagttcaagaccagcctggccaacatggtgaaaccctgtctttactaaaaatacaaaaactagctgggcatggtcacgtgcacctgtaatcccagctactcagaaggctgaggcacgagaatctcttgaaccctggagacagagatttttgttgtggtaaaatatacataacataaaatccacaatttgagccatttttaagtgttgactatacaccatttaaagcaacaaaaatgtttgcaaattcgggttttatccaacaatgcatgcatttcctgtagattttattctcacctcacctctgtatgaactctctgcctctgcttctgtcaaatgtgtccgttccctaatattagacatactttgtgctttcctgcttaattaattgtttatacagcccttctctttccttttcacttctgctttcctggccaccacacctcttcctgttgggctccatggtagacatccatcagcatttactccttgcctcccagggaatctaggtcataaagggcaccctctttgtttatagcacttaatagtaattgtaacatctctatgttgtctatattgtcatttacctcttctattaactattcacatgctaccagataacttcttttattaatctgtatgtatatgtcaggttctatagtagatgccaggtctccaatagtaaatatgaatatgattattaatattaaatatgatttgtctccttttctcatggaagttttatactctggacaaagggcagacattgaacaatcactgtatcaatcagaataggctatgttgtggtaggctaacaaccttcagcaccttcgaacaacaaaggctgattaatttcttgcttactccatttgccctggtggctcagctgtgactttcatggtccttactcatggaccttccacactgagggagcatgctgcatctggggaattttggatatcaggagcactgagaaaaagagaacacagtaagtctcaaactagctcttaaaactccttcctcacttctcctcttgtttcattggcaaaaacaagtgacacggccagttctggcttcaatggttgatagatatgtaatcttcccctgaggagtttgggtatcgtttaactggatatacaggctatacatacaaatgcacaattgcacatttttatgagactcaaaacccttccaaagtaaatttgattacttctgtttgaatttggttttgaattttctagaattaaagggttcgaagaaatgtataaggataatcttgtccaatcccaaatggtttgacccatgactctcaatctctgggcctctgcataagagtagagactaaattattttataggacaagaagtagagtaaacatcctaagtgcttgccatagagtaagtaatatcacacacacacacacacacacacacacacacacacacacacaccacacacacacatactacacacacatacacacacaaaaagatagatatatagggctgggtgcagtggccagggaggccgaggccggcagattgcttgaggccaggagtttgataccaacctgggcaacatgtcaaaccccatctctccaaaaaaattacaaaaattagctacatggtggtgcatgcctgtagttgcagctactcagtaggctgagttgagaggataacttgaccccaggaggcggaggttgcagtgagctgagatcgcaccactgcactctagcctgggtgacagatcaagaccctgtctcaaaaaacacaagaaaagatagatagatagatagatagatagatagatagatagatagatagatagatagatagcaagtgcttataccatggaccattctaaatgtttttcatctattaactcaagagtcaacaaactttttctgtagagtaacagacactagatattttaggttttgtgggccatgagatctaggttattactacataactctgccactgcagtgcaaaagtggccacagacaatacataaacaaatgatcttggctgtgttccaatacggatttatttacaaaaacaaacagtgagctggtttgacctctgttttaacttagtttattctgatgacaaccctactgttatccccattttatagaagaagaggcctgtagaggtacagtaatttgtagaagtgcagttgaggcttgtagaggttcaatcatttgtcaaagttctctcatctggtaagtgggggagccaggctttcacaaaggcaagttggctccagggttcatgatcccaactgttaggattcatttcttctctaataatgctactctgctgaattcagttaagctatcgaagtatggatcagaaaagagggttgggcttccaatatatttgctcattttatggatgatcttttctgtctacaaagacaaaagacacaaattatttgtggtttcattgtgctggggttgtgtgatttactgagccacactaaatacacaacaaggtggtatacaaagtggtcaaatgtaccatctgaatcattcttgacatacacggacacacaactttgggggtcttcaagtttccttctacccttcccagcagggtagaagagaagacaaaaacacagcagaaaaactctgtccaagaatgggaaagagtagttatggcatgcttaggtggtgggaaacagctgatttaaagttagtaaatctgaatccaaataatggttcgatttctctgtgcaaccatgcttaaatccccgtgcttctccaaatcggagctttcacgtctgaatcatggagatagtatatctactaacagatgtgctgtgaatgataaaggagtttaagtaagtgcaagtgttggctaaattacagcatcttatagatatatgtaaagtcatcgctattactggattgtccttagaaataagggttttgcttttgttgtatttcaaggtgacttaagtatggttgactgcatatagaaaaggaagaatccaaacatgtactcgctgtaattgagtctttaaattgcatatttaaagaaaattactagcttttaaaatcccaagtgattttagagaagactcacagaattgttaaggctttccacaacatatttactcatatagtgggggtggaaggagttggatttgcccttgtggttttcatagagttgacagcttttcttgcctattccacaagttctaatgctacataatttttaagatttggtccactcagctatcactgtgatctcccaacttaaatctgttatcaatttttcagtcctctcctagttctttgcattcacttctatttgccacaggttattagagttatttgtccattcattcaactaacgtgtggctgtctattatggagaggcagtgtactagatgttagggacacaaagctcatgaagtagatatggcttctgtcctcagtcggtgtatctctcagtcagaatctgttacttgagggggcagctggagctctttctcccttcctagtaggctgagcatatggaaaccagattcccagttaattttagttgttgttttcttgatacgtaaagaaaagatccataaactcaagatgctttcttatgaatcaagttttcaagttttatagcattcgctttgtactacttgttttgaccccattgagaagttttatttcttctgttctcctgattcttcgccattttagcagcaaatatgtacttaccatccactatgtgattgatgctttggaaatacaatggaaaacttggtagcaatgaaccctctgcctttaagaagcttatattctattttagattagggaagcaggaaggtctctctatgtacaatagaatgggaaagaacgagccacataagtggtgtcaaagaggaatgcaaaaagacagcatggctggagccaagtgaaactaaaaagaagatgaggttgactagagacatgattcagatcaccagaggctgggaggcaatggagagcattttgatttgattctaagttcaatggaaagtcaccaaagagttctaagaaggagtataacatagggtttgacacagtgggtgggtgaagaagatcacacttgctactagagatggggagtacgttgtagaggggaaagtatgggtgcagagagatcagatgggggttatttcaggtgtctacataagggatgatggtgacctcaaatggaagtagaggtaagtggagagatgtgagatacattttcagatagcaggagtaggacctgctgatgggtgtgttgacatgggctgagggcagggatgaggcaggaagatggtaaaatcaagaatattcctgggttgcgcaacactcctctgtccactccctgtgatgcgatttggcatttcccaactctgccttccctcctaaaaatcaggaatcggtcttatattaattttattttgggttctgtatctgttgaattccataaacatctctcatttttttctggttactcattcatctatcagaaattgtgtaaagtccatattttttcaaatttagacacctaaataataaagatttaaactattaataaacatgtacttaatttcaaaaagagcctgctagacataggtgaatagggtttcccatttcccgagaggaggaagaggtgaggaagattgtgtggggaaaattgagaggaaaatggagcagtagtaaaggagaatgccagctaaagggaattttgttttgttgttgttatttgtttatgtgttttttgtaaagatgagatacagtagagcatgtttgcccagtgagtacagtgatccaatagagaataagctgtcgtggtgcagatacaagaaagataaaagaacagacgtaatgacatccttgagaaggccacagggtgggggctttccagctcctgcagcaggatccgccttgagtgggtgattggggtgggtgcagggtagagagagattctaactgagcaagtttaggatgagggcttgcactccagaaaaggctggagaaggcactgagagagctgttaggagggaagccagagatgagaaacatagaatctcatctcagggagtgaaaaaggagactcctagacacaggatggtgggcctttgttgagcgactcttccatagaggaaagtgccggatagctggtttctggagaatttaagtattactgtattatacattataatgcatctttgtataatgtttttctcttattccccaagatctttcattttcttttggaaaatgtggacagttagtctccatgtatatctctgtggtttcttactcttatattaattttgttttgagttgaatatcaattgaacttcatcaacatctctcattttttcaggttactcattcctgtttcagaaattgttcataaatgttcattattttcacatttggacacctaaataataatgatttaaactaaacatttatttaacttcaaaatgtatatactatttgccttttttatggtgagaatatatttgtataatacctatttatgtcaacacagcaactaacataataaatatactcttagattataaaagctcactttatataatcaaagaattttctttatgttataaaataactggtatgaatatgctatttagattatcattcaattacttacacctcatttctttcaaaatgtattggagatatttcccaatttgcaggtgcttggaaggttggagtgatgagtgtgtgtttgtgtggatgtgcttttggatgtgtatgcacacaaaggtttcttctttcctaatctaatatttcttttttcttttttggcctgacttctatacacaattttcttagcccttctggtaggttatttaggaactcaaaagtgctgggtattggctttcatgtcctgccagccttccttcttttctttgggagaatgttctgcattccaggagaccctgctcccaagcatcattcacatggtcaggctgtccaggtgcctctcaccccacttggagatgaggctgctctgttttcctactttggtaatccctgcctctgttctaagggcctggccaaaacatggaaagtcttactcttttttcaatccgatcttacagcagtgctggtgacattttattctaggtagatgtttgcatgaggcagttcttaaaaaaaagtttaaaaaaagatctttctgtctctgagcttttttcatctatttcctccttctgtcatatttccagaaggtaattgagagtcagttatgttttattttattttaacccagtgatacaggcaatgatgagtttgcatgttagtaaaatgggaaaatgagatgtgtagaggctgaggggcaaaatgagaatcggcacaaaaatctgattgatacaacattctgtgagaggcaagaatgtccctgttaggcaggaagccctgggtaagataacctggaatgggtgtatatgatcagaacacagggcaaaaaaaaccatcctcaagacttatcgccatatgaagactgaaagacaaaccaaccttctgagtgaactcactgaaaaaaatcttgtgtgcctggaaacattctgaaaggggcccctcccttgggctataaaatcaatggtgaatatcattatcaaatcagatatgggtaagcttttacagcatccagttcccagtgactatcccttaaagaacaaaacaaaacaaaaacaccactatccgtaggcaagtgttttctcttgaccacatatttacatatgaaagtctattctggggaaggacagtgaggaagatggaaaaatcaatgaaaagctccctctttgaatttgtagaggcctttctttcaaaggtgagcccttctgcacagatttgtttgcagagacccacacaggccccatatttatttagttcctatttgaaaagaagctttcctcctgccttagaagaagctcattacagatagacttcacctttctgttgcaaaagatgtttccttgaaatgaaaatgtaatgagtgttagatcagtagcatgtagctgccaggctatctctttgatccagtttggaatgcatttgttaaaaagctgctttattgatttttttagctgctttttgctgtgtttggatcatttgtacatatacacatcacaatttttgctacatcaaagtgcttaataagttcactgcactcaggaaatagcatacaaaacaaaggaactttgctctataaagatttctgcctcttaacctccagtatgaaagttgtttttaatgtgtttttttttttctgaatagcttcaaaatattttatgcagtcttcaatgagtcagccagggccccgcttcagatctccttctttgaaaatgatgcattctggaaaaggaaggatttgattgaacgagtaaacacatctcacatccattctgctggacaggagtcattttacttcaattaattatttaattggctcaatttgtgggtagcggcagcttccaggaaagtgttgacaatatttgatgtatgtgaggatagctactaatttagtaataagttgaaatttactaggtaactaatgtgatgtttgtttattaggtccaattatatgacaaagaatgagcacattataacctttaatgctgattttttttttttttgtatcatgtacatacaaatcagtgttaagtgcttttaactctaaacaggtatttcctgggggcagactcggagccagctcagtggaaagcacgactgggaagacagagctgagtttgctccacttttggtctcaggccaaaagtgctgactgtggtcaagtgtgggctgcacagaggagctgtccaatccagctttccaactagacccctcgtgctggtattcgggcaggctatacctcctgcagatgtacaaatgaacatgcattaaagattttatttacctcattcagtgagggagctaggaaaacattataaacagttgaaatggggatcaaaaccaacatttatttgtcagtaatagtgaaatgaatatgcaaatggagtcaaaactggtttttccatgggaatggtgtcggtggggagggaaaccaattaaacccctatgacaggtggaatttatggtgttcattagttacctacagactataggtttgtaaaatagctcaaagacaatgaaaacttagaatgtgataacctctagagtctagaaattgtggcgcttcccattgaagcacacctttttttgtacacctccaacagtggggcggacactcaaatccttttctttttgtctttaaagtcaggaaagtacgttgacttcaggggtcaggtgaaggtcaaggggtaagaaaataggaggcaggtgataattgtgggcttccagtaatattctggtaagtgaaaaggaaacatgacctaaaatagcaatgcatcaactgagtatttaaaagtcttttgtcttttctagaaattttgtcatcgtggtggtagttgatgtaaaaagtggttttcctactttgaattttatcttttattctctctctctcttttttcccctccctcctttctttccttccttcctttcttttttcttccttcctttccttcccctcccccctccctccctcccttctctctctctctttctttctttcttttccatgacctcattcagtgccagttcacattttcatcttgatccatccctttgtacattggactctcaaaaacagcaattcttaacagctcaattggatttgccatttggggccatctctgtacatggcctctaaataaatttacgaactccccttggtgcaaaattgagatatagatgaatgggtggctccctaagagaggaacggggacacctgggtctggtggaaccatgtcctgaaagcactatatgactttggcaaacagcactcttctctgggtgccatcccatctggtccccaagcagaagtcagagggtgcttagcagccatggcctggcctggctgcaaagggcatccagtcagcattgctttgtacactggagctttgaaccagtgatcctcaagcctctccagtcaggtcactgggaatttatactttcctaaaatgtccgttttcttgctgtttgcctcagaatgaaatctcacctcatgtgatagtagtcatgaaacccaaagacacaatgtggagaggagttcacgagaatgcctggtatgaggagagcaccccaaatcactctttatgagctcatctcaaatctcgggctccacttatcccacggtagtttttttgtttgtttttttgtagttataaagatataatttacatgtaataaaatttatttttaatgtgtatttcttcttttgaacatatgcttagagtcacactacaatcagataatgtttctgtgggacacccaaactttcctggtgccccttttttgtcatttttatccctggtctcccaactttagtaaccactgttgtgatttctgtctctatattttgctttttctagaatgtcatatcaatggaatcctagaaatgcaaacttttgagtctggcttctttcacttataatgcatctgagatccatcaatgtcgtcacacgcatcagtgcacgctgagtcgtattcccttgtataaatggaacccggtttattgtctcacctactgaaagggaggttgttgggttgtttttagtgatgggacatcatgaatacaaccagtagaaacgttcatttacagattttttatatgaacacagtgtagtgtttctgaattggatgataaatacgtgtttaattctataaaaagctgtcaaactgttttccaaaatagctaatctatttggaattctcactagcagtatatgagagttccagttgttccatcatattctcaccatcatttggtattgcctgcctccctcccttactcaatcttcttttttcttttctttttttccattatattctcaccattatttggtattgcctgcctgcctgcctgcctgcttgccttcctcccctccctccctctctctcccttcccttccctttttccttccttcctttcttttcctttcctttccctcccttccccctccctcttctctccctccctccctcctttctttctttctttctctttctttctttctttctttttcttttttctctctctttctctttctttctttttcttttttctctctctttctctctctctttctttttcttttttctctctctttctctctttctttctttttcttttttctctctctttctctctctttctttctttttcttttttctctctctttctctctttctttctttttcttttttctctctctttctctctctctttctttctttttcttttttctctctctttctctctctctttctttctttttcttttttctctctctttctctctctttcttttttctctttctctctttctttctttttcttttttctctctctttctctctctctttctttctttttcttttttctctctctttctctctctctttctttttcttttccttctttttctctttttccttttttcttcctttcctcctttcttgccattctactagatttcatagtgttatctcatacggtttaaatgatattaccttaattactaatatgttgagcttttttttttttctttacatgcttaaaatcttctctgttcaagtgtctgttcaaatcttttgactgggctctctttcaaaagctttccaattcaaattctatctttccaaaaatatgaattcattaagtctagaaagtatcgatcggcgtatttacaatgcctgtggatgcaatggcgaaacaaactcctagaacagattattttgtagtaccttaatacatagatattaaagcagtaatcaactcaagccagagtggattcactaagaatgaataatgtaaagggacccatttcctttctttttcatgaattaacttaattttatattagaatagttgaatagatatattttatttcatgcttgtgaacaaaatggagaaatatgaactgcgtaacaataggtaaattatattttgttgaaaaactattaccccaacatattaatctttttgaatctgtctagctggaggaatgttccttagtaattaaattcaaaataatgtaatcatcaaaaatattccaattaagtcaacaataattgttttataaatattattaaatgtgtatattttattcttattttagaaatatcacatattataataaatctggtatagtttcatgggagaaggatcctctgacattcatctcagaatgctatacttcacttaaagtttacttccttttgttatattaaccccacttcatgagatgctatttactctactttttttaaatgtgtatgcctcactttaatggtgttgcttttgttttttttaaaattgcttatctttatatttgagctttccttttacccggtgggtttaagtggcatactgcttgcttcagcctatttcgagtaattctgaggtagaggcaggacagattgcgaggcctgtcatgccaggagctgcaaagtctctccccttcttcctgggtcttggtagacacttgagtttctgccatgttgtcccttccacctccaggcgctgctcctgcctgagttctgcagccaagtgccctgtgattgctataagaaggaggaatgaggactggggggcggcgatgcagcaaactgaccagctgccacctctccattctcccagtcaatctctctgatcattgtctctgcgctagctcacagtctggaagcttggagagcctcttttgtttctccacttttttttttttctcagagttctctgtaaaagcatgttttgggttgtgctctcctgtttcaattaatttatatctaccctctgacttttaggaacttattatattatttgacaaagcacaaatgtgcagaaaaatcctaggcctaataaacccagatgttctggatgcagattcatgcttctctctcatgaaactccgcctcccaggccatcagggtgaaagcagggtggcagctgctgtgaggacagcgctgccatgcagcgctagagaccattccccacaccgcacctgctgccacggcaacaagcacccctcctgccctccccctttagaggatgtcatgtggaagttccataaaggcaaagaccacggagagctcatcagtggattttacccagtaacattttaaaatgtatttattccttcttcgtttggattttctgaaaacggagcacacatttcgataggcatcaagcagcctgttgatttcatgtgtactaactagcaattttcttcttatcagagatgcttattgaaacacgaggctttcatttcttaatacaatgacacctttttaatcagtcccgcacagctcttaattcaggagccagaatgtcagtgaataaagttctccttagaaagcagacctgacaattcctatggttcgtgaggcttcaccttcacccaggcagccatattgacaaaagccccaagtgtgttgcaaagtgggtgggtgccggtgttttgcctgcttcgcgttggaacacccgtcctctgtctggcattgctctgcagtaggaattttggtgggaaggaagaagttgcagaatctgagtcagcagagtctctatttctagatgtgcttgtagctactctatggacacctgacctagcttcttctaagtcagtgctcctcaactgagcacaagtttgaccccagaagtcatatggcaatgtcagcagacagtttcaaccataacgactgggagggagctgctggcatttagtgtgcaaggaccaggggtgctgcttacgcatactatgatgcatagaatgttcccacgaaaaacaattgtctgactccaaatgtctacagcgccaagcttgagaaaccctagtctcagttacagtacctgggagccagtggatctccagtgtcctgctcgggtcctagaaggagctgggagggggtagattgtggcctctggtgttctgtgatggcagcagcaacatttactcaagactcattctgggccgggcgcggtggctcacgcctgtaatcccagcacttcgggaggccgaggcgggtggatcacgaggtcaggagatcgagaccatcctggctaacatggtgaaaccccgtctctactaaaaatacaaaaaaattagccgagcgtggtggcgggcgcctgtagtcccagctactcaggaggctgaggcaggagaatggcgtgaacctgggagggggagcttgcagtgagccgagattgcaccactgcactccagcctgggcaactgagcaagactccgtcttaaaaaaaaaaaaaaaaaaaaaagactggttctgtgcctggcctttgttctgggtgttggcttctgcctggctgtcttagagtctatttctggtgtctcataaccattctttttttttttttttttgagacggagtcttgctctgtcgcccaggctggagtgcagtggcgggatctcggctcactgcaagctccgcctcccgggttcacgccactctcctgcctcagcctcccaagtagctgggactacaggcgcccgccactacgcccggctaattttttgtatttttagtagagtcggtgtttcaccgttttagccgggattgtctcgatctcctgacctcgtgatccgctcgcctcggcctcccaaagtgctgggattacaggcgtgagccaccgcgcccggccaataaccattcttaagttccgtgactcactagaagggctcacagggctcagggagactcaggactatggttcattacagtgaaaaaacacgcagtggcatcagcaaggaaaacaaatgcaccaggcagtgtctagaggagacccagcagtggcctccaaagtcttcctgtggatttgcgcaagacacactcactcctccagcaatgaacttcagtgatgtaagccaagtgtctaagcccagggagggcagcttgggtctcagaggctagagcttttatcaggagctggtcacacaggcacctatttccaggaggaaacgtgaccaccgtaaatcatgctattgacttggtacgaaccaactagataagcttgggcagcatgtgtcaggaccccgggtgtacaaaacaaccttattaattagcagcgcagggaatattgcagggccaagttttcaggagctggccaagggtcagttaggccttcctgaagagatgtgagactctggcactgtcaggcagctagctctttcctgcacactgcagttgtcaaaaacttcccagtcattctgtgctttcttcagtaacctttcagtgaagccctttctgctaaagtcagacaagttcagttatttctgcttccaaccaagaacaggagctgactcatacacaaggtaattcaaaaataataaccgaggcctcttgtgttgtttgcatggatcttgtatgcatgtgtgtgtgtgtgtgtttgatttgatttcaaaacgttatcatttctatcagaaagggagctttcttgaagacttcatgacagccacacatgagtccttgggctggtgttctagggaagcacattatctgcccgtggcctttaatgatatgcatttaaaatattttttctttttttaatagagccgaagacccaggacacaggcaaagactgcccatatcacatttttgacgtttgttgatatagagctctctgcccaggaaagactttagctccatctgtctgcatgttattacacatcccaggccacttaatacatccagcttagctgtggtctgaggtaccctgcttttcttaggtttgaaatgaatgcagctcatgcatgtaagatgtgtcataatctcttaggaagcaatatcaccactcaaaataatgaaagatctcggaaagaaagggtacgaatttgttggggaatatttagccatgttgtctgactttcttacccaccacgttttttgtttttcagagccattgaagataatgaagagatcactcttaaagtgctctttttttcttttcagattttaatagtaaagcagaactttaaaaaaaaataaagctgataaaaattattcatagattcatcatttagagaaaattgctgttaacattttggtatataatattcccatcaattttcttttcttttcttttttttttttttttttgagacagagtctctctctgtcgcccagactggagtgcaatggcatgatcttggctcactgcaacctccacctcctggttcaaggcattctcctgggtttacaggtgtgtgccaccatgcctggctaatttttgtatttttagtagagatggggtttcgccatgttggtcaggctggtctcaaacttctgaccttaggtgatctgcccgcctcggcctcccaaagtgttgggattacaggcgtgagccactacgcctggcccccatctacttttaaaacgtgtgtgtgtgtgcacatgcatacatatatacataatgtatataaaatatataataaaaacataaatatatatttatacatgtggcataagtgtgtgtatatagagatgcatgcacaggtagtcataatttatgcagcaatttatacataatgtatatcatgtaatcctgttgatgttcttctgaaacatgtgcctgtttcattgataccacatcgacctgcaatattcttctgcatcatggaagaatgtagaatggccgcatggtattccatctcatctcatacgatagtcagcacttccgttactggacatacaactgttaccatttatttgcagtcacatgtcaggctgtgattaacatgtttaatcaaatctatgtgcatatataattttacctccagactatatcttggtggtagaatttctgaaccaaagagtgagcacatttttcaaacaattgaaactcatggccagttatcctccataaaagttgttccaaatttcacacagtaggtcttttttcccatgaacttgccaatcttaatgatttctaatttttaaaaaatctcaacagtttggtgtttgtaagtagcttttcattataattaaaacaaccttgattgttaaggagtagccagaaaccctttaaacaaaaccttactggtattttttgtttgtttgttttaaatcaggatgtcagcctgtttaaatttaccaagtacatgaaaaggaaaacaaaacaaaaatttcttgactctaaaaaacccttagggtggtctacagcctgcatctctcttccatgacttccatgactgcatctgacttccatggcctcatgactgaggcctggggctgcactcagcaggacaggccaccttaggctgggcccccgggggcagtgccaggattgggactggggtgggactggttgacaggagtcttctcaaattatctgtgcatctcacaggggaatatatgggtgtgcttttttcctttgataggatggattaggaggactcagagtttttcttttgtgcaaggataacgatttgctccccaaattttgattgtctcatactcattccttttctaattatcccatatttgttaaatacaagataatagattctgacaagcaatcagcaaatgggcaccaagtgatgtgcttcattttaattggattgccttttttttttttccttctctgctaaattatagcccatcagcatgagattccctgtggtgagcagctaataatatgcccaggtgcagccaattttacttcctaaagaagaactagtagctacagatccccctaaagtgaagtggaaaagtgggctgtaatagctcgtctcagcagtgcggcatgctagggcaacttttacatccggatctctattctaacaatttttttttaatgcagtggcaattaatttgcattatattgatgaattaatgaggcacaggacagaaggttttcttagagacttctgagaaatctcttgtttaattttgccttagatgttacaatttttaaaaaatcttttttttaagaattaggaatataaaaccactatagataaacacaaatgaaaatatcactgttaaatgaaccagtgaaacagcattccatatgtattttccaaagtggtgctgggatgtggctttgctttggtgcacaaaccatagacaaatgtacccaatggaatgtcagttaggtttttgggaacacttttccctatttgccattaataatgtttgttcctatttaaaacattttagtgacttttaattagctacaatgaggtgagagtatatgttttaatctttatctaacttaattttatttttaagccacttgaccatgatgtgcagttttcagataaacccaaatattctttctgaggctgaatcaatagagattttcgtcatcacatactacacaccatctgtcacagccatctatctgttactctcttggtcaagtggccaccaatactcttgagccaacttgaaaacatatgggaaagacagtaaagggacaaggattaaagattcctgtcttaattcttgaacctggaaagaaaaaatgaaggaggagaaaacagaaatggagaaaacaacaatctcccctccctaccaagacagggagggttttcagggtgacctctcagtgtgtcttcactcagccactgccttccatattcctgccacattctggttcagttactattgtccacacatgtccttcttcccttgcagtttgtccatctccacacttcagccagagggattatcaaaaccctttgataacatataacagacatcctcatgctgtataacaaacatccccttaaaactgccattggctatgtttgtaaacatgagatttggacaggactcagtggagcaactcccgtctgctccaggatgcctaggacctctgctgggtagacaccaatggccagtagacagaaatctctttctcctcgcggcaaatctgacttggggatttgtagaggtcattgtcattcatgagctgatatttgcttctcttcagctcattgccaagtgtcccatccacatgctatctctagcatggtgctttctgggtagtcacacttcagggcttcaagagaatgttctcccaaagactggggtggactgcaaggcttctaaggacccgaacttggagatctcaggacctcacatccaccagattctcttggtcaagcaagtcagtaggaccagtcagaattcaaagagagaggggaattaaattataaatctcaatgagcagagcagcaaagaacttgaagacatatttaatttctataaaatcgtgttggatcatgtcaccctctaagcgtacaaccttccaaggcttcccattgcttttcagatagaatccagcactcaccccaaacagcctgtatgttcctgctgaccagactcatctcacaatgtgctctctgagtcctgctctgtgtatttcaaatccactgatcctttatttctctaactatggtggttgtcccacctcatgttcctctctttgcacactgtttagctaaagccaagctatcttccaagtctctgtttaaatgtcacttagtaggggcaacctccactgacccatgggtgcagtcaagcttccctgtcttagcatccagaattatcaaataattagttgtgtgatttagtatatgcttcactgaagtcccatgagggcaagggcatagtgtgtggttcagagctatttgcatagcacctagaaaactgtcctgcacacagttggcacttactaaatatttactaatgagtcaacattacattagccaaccttaggaaagagtgcttacctgtgcatctcaaatgacaccaactttgtgaaataatagtctcctgagacatgctggatctgcaccatccagtagggtagccctggccacacacagtgttgggcagtcaaagtatggctggtctgaattgagggtgccataaaatacataccctttttcaaagacatggtgtcacatcaaagggtatcaattgtctcattgatatttcatatgaattacatgtggaaatgataatagttttgatacgctgtgttacctaacagtattattaaaattgaaaactaggccgggcacagtggctcgcacctgtaatcccaacactttgtgaggccaaggcaggcaaatcatgaagtcaagagattgagcccatcctggccagcatggtaaaacccagtctctactaaaattacaaaaattagctgtgggtggaggcgtgcacctgtagtcccagctacccgggaggctgaggcaggagaatcgcttgaacccgggaggcagaggttgcagtgagccgagatcgcgccactgtactccagcctggacgacacggtgagtctccatcccaaaaaaaaaaaaaaaaaaattgaaaactaatttcacctgtttctttttacatttttatatgactttttgaaaatctgaaaccacatatgcagttcacatttatgtctcatgttatattttgtgggacaaagctgctctgaagagaaggttctagggtgaaatgtacttggagaaattctgcaagcactctcactctttagagggtttgcaatgaacatatcaaaagccctgagaagtcctgcagcaaaactgctgttaactctaagccagtgcatttcaaagctgactggaccttgcataggtctcatctttttaagaccttggatattcacctcccatgaaacacacttagggaaacatgattaggtgacggccaccctgatgcctggccctgaggtcgtggacatggttcatgtaaaactgaatcttattatgcagattagaggcagagcctatggaagtgcatttttattgggggaggggaggggatggaatcagacacaggagaagtgccaaattcaagcactttggcagaatcacacagccccacacataaagtcgtataagcacatatgttcccaccggaagctggaagccgcttctactctgatggaggggatggggccttgccagccccagggtcatgggcagcccgtgctgggctctttacagacatctagggctgttccttggtttgccttatttctctagtttgctcagtttgctgaaggggcaaaccaaaggtaggacacaagttcaggtccacaacggctgggtgcagtgtccgagatggaggggagaaatgtacaccgagtggccgtcagggcagcagatggtctgcaatttcctcccagaaatgtgggcatttttttctttctacagtaaagagtggatattgtctcgctgggctttctgaatttcatttttgatgagagatttaaatatgctgtttctcagcccagaatcctcgagatgttcgtgtggactatgtcccaagccccgtgcttgttttaaaggtgtttggttgtcaagaaaggtatcctgtgaacctaagaaatagtccgtctccctatgaggcaggattgtggcctcttttaaattaatcccacgtgaactgtgacctctttgttggactgtcaccagaatcatcttgatataagagcactgagtaataagaatctaaccagagcttgaggcagccgtgatagtctcaccaccatctgcccatcctggagctagactttcccaggcaaggcctgcctgtcctctgtcaaagcaaatgctggcctcccattagctcctaattctaataagggtttctattttatccacttacctctcctccagttgatatttcccaacatcttttttaccatcttccccaacaattcagtcctaacaatgctctccccttcctgagtcatctttccttttctcacagaagttcatcccttccacactgcaggattagaaagatcactaccttgtgttattctcacagagcagagatgccaagcatttccccacaagcataaatcttaattgccgtccttgctacaaatcataaataaccctagcccaggtatcattgcacagaaagccaggcaaaggagacagaaagccaggcaaaacataatgaaaaggtattaattgataactaaacaggtgttctatcttgctccagtacaaattttatggcaacaattttgttgaattgcttcttctggcattgaaaatttcatatgatgtgcatagtttcactctttctaaacccatctggggaaacaacaacggcaaaatcgtgatttaaaaatctgaagcaggctgggcgcggtggctcatgcctgtagtaccagcactttgtgaggccaaggcaggtagatgacttgagtccaggagttccagtccagcctgggcaacatggcaaaatcccatcttttctaaaaatacaaaaaatagctggtcatggtgtcacatacctgcagtccaagctatgcaggggcctgaggatggaggactgcttgagcccaggagctcgaggctgcagtgagccatgattgtgccactgcactccagcctgggtgacagagtgagaccctgtcccaaaattaattaattaattaataacaatctgaagcaattcaacttattcaaaacactttacccagaaagaacttgcaaattacccagggtgaaaacgagtggtagctcctggaattaataaccttaaatttaaagaagagaagaggtccctggtacacttcaaaccaaaattgttgtatcctttaagagtattgcaaagttaactttctaaatatgtgaatttatttaaatttcccaacaattaaaatgaatcaatgtttcccaaattgtgttccattaaatacttctcagggagagtttgaaagttctgcatttgaatatgggctttgatggtcaatagacttgaaaaatacctcatagtagagatctactaagaatacaacgcatacaagcacactaaaagtgctgagatattctgttgtcaacacacctgtttcacttcagctaaccttttccagagcttatctgggcacaaaacagtttattttgagctgtatctcttatttttccttagaacaccgtttaggaaatgagaaaatatacaatgttacctggtatacaatggcacggtttcttttttgttactctgctcaacacacctaaccatttctccctaattttaattttgcatataatcacaggatattttgctgttctttgcagtttcaaatatattttcaaaatattaatttttatccctaatgccagaaaaatacactgctatggcatttcaaaattgtagccatgaaatagaatgagatgtgatgtcatcacgtttttaggataatttctcactgccactagaaaaatacttcagcagaattcatgaggattatgtatattttataatcagtctcctcctaccatttatggtgctctttagaggtgataattctgtcttttgaagatctctggatcacaggaacaagagtgatggcaacaccaagagcaagccagggccctcctgaaactccccccttcctcactcactcttcactgcagcctctgagaagggaccttggccctgtaccaacttccttctccatccaaagtggcacctatggaatggcgcctctcaatgtgggaatattctaaccaattgctttgtattagttcattaccttgctgctgataaagacatacccgagacagggtaatttataaagaaaaagaggtttaatggactcacagttccacgtggctggggaggcctcacactcatggcagaaggtgaaaggcacgtcttacatggcagcaggcaagagagaatgagagccaagtgaatggggaaaccccttataaaaacatcagatctcatgagacttattcagtagcatgagaacagtgtgagggaaacccccacccgcccatgtttccattacctcccaccgggcccctcccatgacacgtgggaattatggcagtacaattcacgatgagatttgggtggggacacagccaaaccatatcatgcttcttttcatttttcccctaaagaaagaatatcgctttctaaaaagatgaaatccctgaaaagatggaatttatttcctaaaaaaaaaaaaaaaaaaaatcagaattaaagggagaatgaggcatatgaaatttggatccaaataacttgaagcacatttcttatatatgatgttctttgtagaattcctttgactgattggaaccatttatcttgctgtgatttcacagcacaggcataattgtgattgttttattagttctttttgctgattaactgaaacataattgtgctttttgaaaaaagagtgtgaagttagttgatttctgaaaaggtatgtaagaatgtaaacacgaggattcttaatatcagtggaagaaaatgactcagtggtgggactgtgttttcacactgctaataaagacatacccaagactgggtaatttatacaggaaaaaggtttaatggactcagagttccacgtggctggcaaggcctcacaaacatggtggaaggcaaggaggaccaagtcatgttttacaaggatggcagcaggcaaagacagagcttgttcagggaaactcgccctttataaaaccataagatcttgtgagacttattcattgtcacaagaacagcacaggaaagacctgcccccatgattcaattacctcccagcaggtctctcccaaaatatgtgggaattcaagataagttttgggtgatgacacagccaaaccatatcagactgaaaacagagcagagagatgttcattccatggaagctaaaaggtacatttgctctgagctgtgagctcgcatacagaagtgggctgctcagctactacagcccaggtcacactctgctgtctcctggctgtgtgaccttgggcaccttctttaactcccatgcacccgtttggtaaaacttggggctggcctgggttggaggccaaattcaaccacaagccagccaatgttagccagctagaggatttgtacttgacaaatatttgtgtttgactgttgacctgggcaatgtttaaaaatttattttgaatagttgccaacactaaacattttaaaggtaacataaaatctggatttccagctcctctggaagaattataaatctggcaatgcaggctctcattcccacctggcagctccagcagtggctttggtgctcttcactccagctcatcaatgtccccatcaccccctcgtggccccaacaccaacactgagacagagtaccagctgccaattgtgtggctgtctctttattataattcagaagcattaaatgatttatgatattcatattcctatctaaagtagagtatttgtttaaagaaaaatgaaatataacatttttatggaaataagaatgtgcattggctgggcacagtggctcacatctgtaatcccagcactttgggaggccagggtgggtggttcgcctgagttcaggagtttgactccagcctggccagcatggtgaaaccctgtctctactaaaaatacaaaaattagctgggcgtggtggcacatgcctgtaatcccagctactcgggaggctgaggcagaagaatagcttgaacctgggaggtggaggttgcagtgagctgagactgcaccactgcattccagcctgggcaatacagtgagactgtcttaaaaaaaaaaaaaaaaaaaaaaaaaaaaagaatgtgcattaagcacatatataagtgaagaacatattttttgtttaaaacccattcacctttgctcatgtttactaatgtcttggcccctgatggcctttcattctgtagcctgtatagagcagggatcagcaaaatggggctcacaggccaaatgtggcccaacccctttttttgtaaatgaagctgtattgggacgcagccatgttcacttattcgcattttgtttatggctactttcatattacaataggacacttcaggagctgcaatagagactctgtatctctcaaagccaaaaatatttatcatttggcccttcgtaagaaaaagtttgctgactttgattttcagcgagggcacccagagagcttggaagtgattactcctgggctcataacatgaaaaaaagctgaacagaatgaaaatctatgacttttctggattcatcagaggattgaggtcacagggcaaaccactggtctgcaatctggagagacaggtcaacacagagaatgagagccaaggtcagcttacagggggcagaagcttgcggagccagtgattggtaggaacacgtaaatggtaagttcaatgaattgctggagactaagtatgtgaggcttgagagttaatatttcctaggagcccctacagctttcttgagtttttcctccaggaagctcaccagattctcacatgaaggtcagagaaaaatcccctccagttctgagcatgggaagtgagaaggtaagtatttgaagcaagcccattgcattctctataagaaaaccatgtccttcaaggaaggctaccttaccagaacattgtccaacttgaggaaaggaaaattagccactggtgcccccttctatcctgcctgcctcacataggaggaggaagaaaagctaaaaaacaaacaaacaaataaacacaaccacaaagcacatctgaaagtcacaatccagggacttgggtatactgcaagctgagattttatcttaagagtatggagagcttcctctccctaacacctcagcatcacatcaacaaggctccaaaataataccagtgaattacagctaagagagctgcaagatgcagcctctattcaagaatgagttcctagggaaacacaaagacaacaagagagaaaagtgagataaagaaactaaaggctgtgtcacctgcagctacatcaaacattaaatacagcccagattcatgtaaaacctcatgctaaaagtctaattatattagctttcattacccaaatactgtgtctgactctcaacaaataatgacaagaaatgaaaggcaagaaaaaatacatatgaagagacagaataagcatcagaaccagactcatatatggcagtgattttggaattattggatatggaatttaactatgattaacagaattagggttctaataggaaaagtagatgacaagcaagaacagatggataatgtcagcacagaaatggaaactctaaggaagaatttaaaggaggtgctagaactcaaaagcaatgtagcagaaataaaaagtgcctttgatgagctcattaatagactagatataaacaagaaagaatcaatgagcttgaagatacgtcaggagaaactttttaaaccaaaatgcaaagagaaaaaaaatgaatggaaaaatagaaacagactgttcaagtactctgggacaattacaaaaggtataacacatgcagaatgagaatcccagaaaaaggagaaaagggagcagaagatatatttgaaataacaatagctgacagctttccaaaattaatgatagacactaaaccacatatccaagaggctcagaaaaaaaaaaaaaaaaaaaagaaatgcaaaaaagtctacacctaggcatgtcatatccaaactgcagaaatctaaagaaaaagagacaatattgaaacaagccagagaaaaacaccttacctgtagagagacaaagctaagaattatactggactttttgccacaagctacacaagtaagagagtggagtgaaatgtacagtattgaacaacaacaacagtaacaacagcaacaaaaaacccaccaagatagaattctctgtctacataatgtttcttcaaaagtgaaggagaaataaagatttttgtcagacacaaaaaaattgagggaatttgttaccagtaaacctgcctttaacatttaagaaaggttaaaagaatgtattcagaaagaagaaaatagcatgggtcagaaattcagatttacataacaaaaggaggagcttcgtaggaataaatgacagtaaaataaaatgcataagcagaattagaaaaacttgctgttatagttaggggcttcagcacccctctgtcagtagttaacagagccagcagacagaaaatcagtaaggttatagttgacctatgtaacaatgccatcaaacaactgaatctaatttacattcatagaatacttcatgaacaacagcagaatgcacattctttacaaattcacatggtctattcaccaagactatattctggactataaaagacatctcaagaaaattaaaatcatagacatcatataaaatatggtcttgattataatgaaattaaacttcaatggaattaaatttaataacataaagacagctgcaaatctctaaatatttggagaataaaaatacacttccaaataacacataagtcaaagcagaaatctcaagggaaatttaaattatttgtaactaaatgaaaatataacctatcaaaatgtgggatgcaatgaaatcactgcttcacagaaaacttataacattgaatgcatagattagaaaagaaaaaagatttgaaatcaatagtcgaagcttccaccttagaaaactggagtaagaagtgcaatatcagcctaaaacaagcagaagaaagaaaataataaaacttagaccagaaatcagctacattgagaccaggaaaccagtagagaaaatcagcaaaactaaaatctggttctttaaaaatgtcaataaaattggtaaacctctaacctggctatcaagcaaaaagaagacatgaattattaatattggaaataaaagagaactcatcaggaatgctttcatagatgttaaaaggataataattaaagggataatagggttatgaaaagccctgtagccataaatttgaatacttggatgaaataaactaatttcttgaaggacacagactatcaagatttgtataaggagaaacagatattctgaatgggcctatatcaatgaaagaaattgactcaataattaataaccttccaaaaaagatagcatcaggcaccagtgtttgcactagtgaaatctaccaactcttaaagaaaaaaaatgataccaattctttgcaatctcttcctaaaaataaaagctgagctgacgttatgtctcatgactatgatctcagcactttgagaagccgcagcgggcggattgcttgagctcaggatttccagaccagcctgggcaacatgacaaaccctgtctctacaaaaaatacaaataattatctgagcatggaggcacatggctatagtcccagctacttgggaggctgaggtgggagaattacttcagcctgggagacagaggttgtagtgagcagagatctagccactgcactccagactaagtgacagagtgagacccaatctcaaaaaaaaaaaaaaaaaaaaaaaaagtagaagcagagggaacatttgctaactcatttgatgaggccagtattatcctaaaaccaaaacagataaagacatcacaagaaaactacagatcaatagctctaatgaatttagatacaaaattactcaataaaatactagcagattaaatccaacaatgtataaaaagaataatgtaccatgatgcatttggatttattccaggtattgaaggatgctttaacattagaaaatgaggaaatgtaacctatcgcattataataggctgaagaatgaaaatcatatgatcataacaacagatgcaaaaaagaatttggtaaaaccggcacttatttatgataaaaatgtctcagcaaactaggaatagaggggaacttcctcatcttggaaaaaagaatctacataaaacctataacagacatcatacttaataatgagaaaataagtttcttccctctaagattggaacaagtaaaagattttccttttcatcactccttttcaacattgtgctggaagtctgagctaatccaggaaggcaagaaaaggaaataaaatatatacagattgagaagaaataaataaaattgtccttgttcacagatgacatggtagtctatttgaaaatctgaaacagttaacaaaaaaatttctggaattaataagtagtcatagagggttgcaggatacaagactaatatatgaaagtcaattgctttccaatgtaccagcaataaacaattggaatttgaaatgaaaaaccaatataatttctattagcaccaaaaaacccacttaaatattaatctaactacatctggacagtatttacatgaagaaaactacaaaactctaatgaaatagacaagatatatagaaatggagagagattctattgtcatggacaggactcaattttgttacgatgtcagtttttctcaacttgatttatagattcagagtcatcccaatcaaaatctcagcaagccaatttttacacattgaaaaactgattctaaagcttacatggaaagctaaaagacctagaataggcaaggagatactgtagaagaaccatgagagaactgacattacctgacttcaagacttttggtaatcactagcttctggtgttggtggaagaacaggcaagtaggtcaatggaacagaatgagggctcagaaacagatgcacacaaatatattcaactgaatattgacaaaggaacaaagacaattcaatggggaaaggatagtcttttcaacaaataatgctggaacacctgaaaatccatgtgtgaaagaaactagacacaaaatttagcaaatattttacaatacgtgctttaacaacaacaacaaaaaaactcaaaattgattagagacccacatataaagtgcaaaacaatacaactactaaaagataatataggaggaagtctaggtaaccttgggtttggttttgactttttagatacaaccgcaaaagtatgacgaatgaaaggacaaattaataagttggtgctatggtctggatgtatgtgtctccccaaaattcatatgttgtgatagtcttaggaggtggggcctttgagaggtgattaaatcatgaggtctctgccctcgtgaatgagattagtgcccatataataaagaccccagagagctgccttgtctcttccaccatgtgaggacgtagcaagaatcaccatctatgaaccagaaagcagctccacacaagacagcaaatctgctggtgccctgatcttggactatccagtctccagcactgtgagaaatgtcagttgttcataaattacccagttgatggtattttcttatagcaacccaagctagctaagatagtttgacttccttcaatttaaaaacttctgctctttttattgttgtatctctgccaggttttggtatcaggagatgatggcctcataaaatgagttagggaggagtccctccttttcaattatttgaaatagtttcagaaggatggtaccagctcctctttgtaactctgtagaattcagctgtgaatccatctgattctgggctttttttggttggtaggctattaatgactgcctcaatttcagaacttgttattggtctatccagagatttgacttcttcctggtttcatcttgggagggtgtatgtgtccaggaatttatccatttcttctagattttctagtttatttgcatagaggtgtttatagtattctctgatggtagtttgtatttctgtggggtcagtggtgatatcccctttatcgtgttttattgtgtctattcttctctcttttcttctttactagtctatctagcaatctatctattttgttaacattttcaaaaaaccagctcctggattcattgatttttttgaaggattttttgtgtctctatctccttcagttctactctgatcttagttatttattgttttctgctagcttttggatttgtttgctcttgcttctctagctcttttaattgtgatgttagggtgtcgatttgagatctttctggctttctgatgtgggcatttagtgctataaatttccctcttaacactgctttagctgtgtcccagaacaatgataacacatggacacagggaggagaacaacacatactgaggccagccagggggttgggggccaagggagggagagcattaggataaatagctaatgcatgtggggcttaaaacctagatgacaggttgataggtacagcaaaccaccatggtacatgtacacctatgtaacaaacctgcatgttctgcacttgtatcccagaacttaaagtaaaataataataataaaaaaaagccttctgctcagcaaaagacacaattgaacaattgagaacgttaaaagacaagccaaagatggagagaaaatctttgtgaaacacatattggaaaaagacttgtatccaaatatataaagcagccttaaagctcaacaatgtgaaaacaaatgatccaatgttaaaaaagaacaaaagatctggaagatcacctcacctaagaagacacagaagtggaagataaagatatgaaaagatgatcagcattatatgtcgttaaataattttaaattaaaacaataacgagatactactctatagctactaaactggctaaaattcaaaaaacttacaatatcaaatgctgatgagatgtggagtaacagagacggcagagtcactttaaaagacagtttgggccagtcgcggtggctcacgcctgtaatcccagcactttgggaggccgaggtgggcagatcacaaggtcaagagatcaagtccatcctggccaacatgatgacaacctgtctctactaaaaatacaaaaattagccgggtgtcatggcgtgcacctgtaatcccagctacttgggaggctgaggcaggagaatcacttgaacccaggaggcggaggtttcagtgagccaagatcgtgccactgcactgtagcctgggtgacagagtgagactccatctcaaaaaaaaaaaaaaaaaaaaaaaaacagtttggcagtttcttacaaactaaacatagtcttaccataggatccagcaatcacgcttcttggcattcatgcaaataatttgaaaacttatttccccgtaaaaatctgcacatgaatgtttactaaaggcaaccgaactaaaatcaaccgaagtgttcttcagcaactgagtgagtgaactgtggacttttactcagtgatgagaagaatgatccatcaagctacaaaaagatcaggaagcaccttaaatgcatacagccacacaaggaaagcaagtctgaaaaagccacatcgtatgtggatccaaccatatgacattctggaaaaggcaaatgctgagacaataaaaatgtcagtgactgccagggatgtgaaggtggcaggtggggaaagatgaacaggacaaaccccagggatttgtgaggcagtaaaactattctgcatggcactagcatggtgaatacatgacattatacatttgtcagaaggcacagaacgtacaacacacagagtacagcttaatgtaaatcgcggcctttagttaacagcaaattcctcacactgttgcaagatgttcataatataggaagttgagtataggggagtggcaggggacagtgcatgggagctctctctactatcgcctcaatttttctatacatctgtaactgttctaagaaataggccgggcactgtggctcacgcctgtaatcccagcactttgggagactgaggcggatggatcacctgaggtcaggagtttgagaccagcctgcctggtcatcatggcaaaaccctgtctctattaaaaacacaaaaaattagctgggcgtggtggtgggcacctgtagtcccagctacttgggaggctgagggggaagaatagctagaacccaggaggtggaggctgcagtgagccgagatcatgtcactgcattccaggctgggaggcagagtaaaactctgtctccaaaaaaaaaaaaaaaaaaaaaaagcctattactgtaaaaaagataggttaaaaaaaaaaaaaaaaccggcttgcaaactttgatttagaaccatgaacctttttatcctaaaactctgtgaaatacttagtaccccatttctgtcattaaaccaacaaaggagacatttcgtttgaagaagatattttcccaagaaataaaacataaatatgaaatacacaaggtcatgtaggaaaagtagattatttttctttaccctgtgaatattgctctcagggtgtagcagtgccctccagtcaggcaaaaattagttgaagctagtaatagccaacctggcttagaaataacggctaaatatatgcattatgttgtgagtgcttactatttattgagagtgtgttttattagatttgggtttctgaaaatgtgataaattaattgggttggtaaaattaactagcaaaaatatttgtaaacagctataatcttaattacaaatgagtttataaactttcattttttcattttaagggaaaagacaagtgtagaagatgatgctgtttattttatttttaatataacatcatgctgccttacctattatcttttgatgaattctggaatactgaggaacatgagcatatatatatatatgaaatatttgtaaaatgaggaaactgggagctattttatttttccccaagagtgattttcagctataaaactgtaatgtggtcaggtcgtagatcacataaaaatcattctatgtttcccttaaaattatctaaatagagttcactagtttttcttaatgtgcacatttcgtatcacccagtatggtcaggggtgcaggaggtaggtcatcttcaagacattttcttgttgcaagaaattaccacaattctgtgttctgttgttcttgtttttaagatatttacctgccaagcatacggcataattatactttccaacctctccaattaagaaagaacttttggttctttgtgctgtggaactctgagtagataagatgttttttcttttagctaactgaataatacccacaaaattcaataagctctttgacaaaaatggccattgagggcctctgagtcaccttacgctcatcaactcccacccgtcaatgaatatcagaatatgggctctaatatgctttaaaattagtccttccttaaaaaggtgtcatgtaggggaagcactcttatatttgaaagcaagtatcagaaagctggagagtggtaccgatcctgcagatataaaaatatctttagtgtttttctaaaacatctacttttctaggtagtacctgtctattattaggggacaagtgagtcagccgtgttgatgtgacgatattagggtccttcttgctacaagctcatgtgccattttaaggcttacccccagagcatgggctcagcaaaccactgcagagaaaacaggctggtcctagtgctctgccttgtgctagttcttgcgcaaaggaaaaccacaggccagcagggcctaagaatcagtccagacacgcacatgcactcacacagagcacagaggccacagtttgccgcctgtggatcccattaccaacagggatgactttaggtaccaggatacttcgtctcattcaggtcaaaacttttactttgcctaaagcatttctcattcgcgatgtttggatccaaagactgtagtaatgctacaacttgcttgcttctttgctattttcctttcttttaaaaatggattctcatcagaacatccctttcaatgtaataaactatatttggatctgatcctcttataaattggaaccagagtatgtggttaggttgtgcctcatcttttctgttgataagtgttttatgtgaggaggttcagaagagctgactttcagctacaaaggttgtgttcccgttcctgaggcaaacagcaccctggccttcagggcagagcttggctgggcctttaagcactgggagtcttttgcacaccttcgaatagagatggctcttggaaacccagtatgtgcctttccctagcaatttctcttttcttttcttttttctcttctctcccttcccttctcttttccttccttccttcctcttttcttttctttttttttgagacaggatctcactttgtcacccaggctggagtgcagtggtgtgatcagggctcactgcagccttgatctcctgggcgcaagtgatcctcccacctcagcctcctgagtagctgggactgcaggtgtgcaccaccatgcctggctaatttttgtattttttggagagacggggtttcaccatgttgcctaggctagtctcaaactcctgggctcaagcaattcacctacctcagcctcccaaactcatggaattataggcatggatatggaaagaaatgcatagcagatggtaaaataagaaggaaacacaattgcacttggtggcaccaaagaaggcctgccctgtgctgcctgggctagggggacttcagaaggtgtcctatttgaaggtgcacccagtaagtgttggttgctcacctcacccaatacctacctgtccttccatcagggagcacatagaattgggctcaagagcatgaaacattctcaagcgatatctctttagcatatggggttccctctacaaagactgaggttactgtcttggcatcagcctcccctcccctgagtaacaccaaaaacacaatcatttgttccatttgctggacccagttgagagcccacatctgttactgtagacagtcaagtttttatctacatacaagttattgattatctacaagttattgattatgattatggcatgcgaccctctgttcacacctaactgtgctccagcatcctctttaggccatcatcccaacattatctctatggctactctttattaccccctaccctgtgccaaatattgtgctaactaatggcctgacagctgttattttattgaatactcacagcagtcttgagacagtcgttagtgtttttatttttcagatgataagagtgagattcaaagaatacaagtatcttgcccaaggtcatattcctgaaacgacaggccaggattactgcccaagtgagtcctctttaaacccaggttcctgtccgctattgtgataagctatgtcacactgtaaaattagtctgctggttaccttccagggactcatggctttgcagaatctccacccaccagccacacatgtccagactctattgcacagtgtattattgttccaaatctaggattgattaatattttcctgttttacctttaagaggatgacccttttttgactttatcccaataagttttgaggtaggggcatcttcctacaggccttatggatgaaaataattctccacaattttaagtatgatagccacctgagattaactgaaaaggggcttgtaagaaagcagaattttgtttcaaatatagggggataaatgaatggacctaagtaactttctgaaaaagcataaacgaaaacaacaacaacaaaatatgctatttaacctgtgttcataggagtcgattaaaaccttctattttggaacatgagatttagcggaaaacatctgtagataggtagcaaatgttagcagctatttaagatgtaagtctgacttactgatgaacatcagaaatggatcactcggtcgcttggaaattcaacctccatttcctgtgtgtaaagtaagctgaactggctcagactgagcattctagctctgaatagtaaaataacagtgaggaactcatgaccatgatacatgatgctttcagataattttaaatagttttataatattgaaacatcatagcctggtatagtggctcatgcctgtagtcccagcactttgggaggccaaggtgggtggatcacttgaggtcaggagctcaagaccagcttggccaactggtttcaccagtaaagatggtgaaaccccatctctactaaaaatacaaagaaaactaaccagttgtggtggagcatgcctgtagacccagctactcgagaggctgaggtgggagaatctcttggacccaggaggcagaggttgcagtgagctgagatcatgccactgcctgccagcctgtgcgacagagcaagactccatctcaaaaacagaggaaaaaaaaaaaagagaaacatcatgaaaaggtgaaggattggaatgctgatagttgaggctacaaaaccatgacataagtctaggagtttggcctttattccaaggaccaacaatttcaagaattattaatagcacagacttaataaaaaaaaattaaaaaatccttttttgtgaagttccaatatataaaacatatgctttaactcttaaatagtgtagtttaagttaacaggtttctaaggcagtaccacacttcagtttagggcagaaaatacttttagtactaattttgaactctaatccagaaactattttggctcttcaaacatttaacttcgtcaaatgtattttgttttgcatcttttaaaacctcgtttccatttaatcactggtacaatatctgcaattcattagctcaacaaatatgtgcgtgcttgtgagttcttctgaactcttaagggctggggacagcaataagttagaattcgatctgtgtcttcatggggcttatattctgtgagagggaaggacaataaacatataatccatggtgatacaagtgcggtgaagaaaataacccagagtgatgctgtagagatgacatggggtgagggtgatggatgagatggtcaggaagggttctccaaggtctcccttggcaagtgacatctaagtcaagacttgaatgtgaaggaagaagccagaaggaacagcatgggcaagcacacagaggcaagaaagagtttggtgtattggaagaacaggaagaaggggtgtttcggagtggacagttaaggaagtggtcagtgaagtgggagagacagggaggggtgaaaccactacaccttaaaaatgatagcgaggtctttacattttatttcaattggagcaggaagccattgtccaaaaccaaataataacttgaccttttgcttcctatttgagtctctttaacttattaaaaataagacatacaagctcatatgagtatgtgatatttgatagatattgagttaatatagtttatcagatatttcaagtatttgaagtatccttactgttaccttgccttaggataactacctaaactccttacagactaattgcattatcagagtaatttctcacctgaaaaatttaacattttatatatgcaaaagtcagattgaaaaagaaaacaaaattgtacttagctctaaaactttaatggggtattactgccttcctggatgttgtagaccaccttcttaaatgtgacacatttagcaattctgaatgccagcaggatgttgtagactaccttcttaaatgtgacacatttagcaattctgaatgccagaaggcagctgggccatgggggagagtcctggctaaggtcaaagtaagaccctgtccctttcttgctctttaattcttgggcagataatgtagtttctatgacacataattccttcatttgtaaaatgggtccaacaagctaatacatattattggtaagctattagaaatcgaatgcattttctccaaatagcctgggccatttgtattgccaacgtatacttggcatatggttaagggattgaagtgaaaaatattaaattagaattcagtttgtccctattataactatgaccacttcttgggaacaaccctagagtttatgtatatttataccttgttacctcactttgttctttccaaactcatttttaatagaattattccaagaaatttaaccctagtggacactttctattccacacaatataacataccctcacaagtacactccttttatctgtttcaaatgtctgtcatactgggatagaaaacaagttaacatacaattttcctctttacttatatcgaatggtaaggaggcttttaacaaatggctttatataacaactagtattgcgtgtttaggtaacaggtggatactcagtactttattggcaatggtgatgagggaattttgatcttggaattcccagcctcctgaactatgaggaaaaatatttatgttgtttataagtgtattattctgtttccagactgggtaattaataaaggaaaaagtcttaattgactcacagttcttcatggctagggaagccccaggaaacttacaatcatgatggaaggcaaaggggaagtaaggcaccttcttcacaaggtggcaggaaggagattgaatgcaggaagttctaccaaacacctaaaaaaaatgtgatctcgtgagaactccttcactatcacgagaacagcatggggcaactgcccccatgattccattatctccacctggtctctcccttgacacatggggattatggggataatggggattacaattcaagatgagattttgggtggggacacggccaaaccatatcaataagccatggcattttgttatagcagcctggacaaactaaggcagttggttagaatacatgtttttaaggcaaagatgaggaaagggaagaatcctggacctcaccatgataaccagatggtttagacagggcaatacccctctaagatgctgcttcacctgagaaatgaggaggataatattggtacaggactttcagaagtgagataatgttcaaaagttacaaaagggagacccaagtatagtctcttgttagtttcttagtatttttgactttgagatttattttttaaagtaatagtaagtgacattattattgctattactagctatatcatctattggctggttactgtcaccagcactatacaaaatcctttaaatatgttacctcatttactcctcacagtgacaccattaagtcagagctgtttccccacattttacatgaggaatctgaagtcagagagtttaatcaactttccccatgttcacactgggagcagagtggtggagatgggatttaattccagctgtaaatgcatggggcagaacccctgcaggggctccatggctcattaatgtgcccctctggcccaagcatgggttaagaaagtggacctaatgatagagcactaaataggggatattcgaatcttgcatttatcaaagtgccattgtccatatcatgttaatattttatatttacatacttccatgtaagtcgcagacctgggatatgaatctaggcctttgagcctaggcttggtcttccctgtgggtaaaaatcctgttgcactttgggtctatttcttagttacattggagattcatattcagtgtttggaatttcttacaaaatgacggaaactgcctactaattcccattgattgaagacacaatatctaccaattcagttctcaggaagaggagttattaggtttaaatttatttttacatcttaaaagaaactgctgagtgataggagaggagagtgttaacttggagtgacagattaaaaaaagtgagccagttcatttgtacataatttttggctatgttatccagacataagctaccagaggacaaagcagtgtaataaatctaatattctcaaatagtttgtgtgcagaagtttagcagtgaggatggttttgtaatgaccgcacatgctagattgcaaactccattcttcactattcatgtacatttgatgtcatatacattgccaaagatgatttcaaaaatgccaagcttctagtctcactttccttagttatgataccttatatcttaaaagggtggtaatttattagttggttttttgttttttgtgtgtttttttcttttctttttggagatggagtcttgctttgttgcccaggctggagtgcagtggtgtgatctcggctcactgcaacctccacctcctgggttcaagcaattctcctgcttcagcctcccaagtagctgggattacaggcacatgccaccacacccagctaatgtttgtatttttagtagggacggggtttcaccatattggccaggctggtctcaaattcctaacctcgtgatccacccacctcggcctcccaaagtgccgggattacaggcatgagccactgtgcccgaactaatttattagtttttattatttcattttgtttagatagaaagcatggagttaaacattaattgtactgtattggctgccaaagcatagaaattgtattttggaggtgagagctgcagggtgggttgctgtttcttcactgattattccccatgagaaaaaagtgacttgttgattgcaatttcgttgtgaataatagttattttcatggtctttggaaaacaagacagagaagtggagagggatatggtagcacggctgggattgtcacaggaaataacttgccccagtctactttttttcatacacatacagtttgagttcctaattaatcagttgaaaaatccagctcctgaaaatatggctacagaatactgatcattgattgtgattcattttgcttcacataaatggttgcattttcttttcaatgagaataaagtttttctttttcttcctctgtcaacataattccctttgttcttattcagttttcttgttaaatgtttttccacatgtagaattttacaaattgaataatacatgcagaaaaaaagaaaaacaacaacctgtctttttttctttcgtctaggtcatgggagaatgaaaaactagaatcttcatgagcattccatactaaatatttgtattagattatcattatttattactttgctaaacaaccatttttatccatcactttttatgaatctatagtaaaacaaaagtaaacagcctccatgctttcaacaaggagagtctgttgctctaaaaatgtccatttcaccacagtttttcctcatcaccacttgctgaaacttactgcatttgttcatgtttattataaagacttttgccatcctgctcggtatttaagattcatcacaagggtattccccctttagatgttctgactaatgttgatattaaccatgtgacattcacaaagtaattttttcctgaatatatgacagtatatattaggttggtgcaaaagtaattgtgatgtttgccattaccttttaatgccaaaatccatgattttgagccaacctaatatcagaggggtaggtaatgcaattgtaagtgagtgttctttggagtcaggtagatcctgcctcttctcagagcagctgaggggcccgccaaggtctgtggctgtaatcctgagtcatgtggatcaggaacgcctttaagtccatgcctggcagctgaaggcatctgcagtttagattctccttgtaccaattttgcaaatctctgcaatattggaagccatgcacccagctgaatggaagcaggtgaaaacaaggccgcatgaagtcatagcactgtgggcagcagtgcaccagtagtagctctttgtgctcaagaatcaaatgatgactgttggcagggattaaaactggggctgactgagtgctgggctttgatcttgccaaatccactgagacagctgaaatttcatgaaaaggtgacaaggatttcctaaaccaaatgcaaattgatgtttaactttcaactccagctcacacccaaaggctttgcaagtgcttgaaaaaagaatatctggcttgtacatcagaaaatgacctttacaatatattttatttgggctaaaacttgtgctgcagcatcactgaaaaaaattactcttactatttaaatgattatacttttcataaaatttcaatgacagagatgctaagtagagatgatgtttattgaaaggcattcttaaaatttgagaaggatttatcaaatgataaacaacattttgtgataaagactatgcattcccacttatttggtaatgcagccagttacggggtacacaccatttttttctttaactgatgtgataaaaaattgtataaaacttaataaacattttccaacatgaatggatgctgtaattaacctatactcactaaaatcagtgtgtggattagcattgtattgggaaaaatatgtgattatgtgagttataacccagattttgtcatgaaaattagatgcttaaagctaagacatgaccctagtgttctcatcagaaatacgggtagatacaaattagatgattttgaggtaattttcagttaaaagtctctgatacatatcctttttcatatcctctccaatggacccttgtttcattgatgagattattacacgtattaattcgctcccaaagccttttttgtatgtttgttgatcacaagattattttaagtataataattttactagatttaaaaattatttttgaaaaggttgtgtcctctaatgtactccttgaattactcatctgctcttctttatttttgtatctggaattagtgccttgttttcctttttagatgctgtgtgatgtggttactgccccaaatgttcatatttgctaccacttagagtccagccttcttctgttgtctaattatatgctattaagactgtcatattgtgttgttaggtacagaaatttgctttagaaacaaactgaggattgcgtaagtattgacatggcagggtagtgttccatgtgtttcttgggcaagttgggtttcaagcatggatctttgtccacacctctcgcaccttcttggaaatatatacagcaatgtcaccagaaatatcttgcaccttaaggctgtctgtcactgtcagcatcacttggaagctggtcaggaatgcaaaatctcaggctctacccagatctcctgaatcggaattgaactttaacaaatcctctagtgattattatgcaaatgaagtttgaggagcgctgggctgaaacatccttctccttcataacagctttgggtggggtgcttctgaacactctttcccaagatgcagtgttgtcattttccttaatcaactctgtctctgggacacagaacagtcaaacaagattttctgtgttagtctgcttttatgttgctgtaaaggattacgtgagactgggtaatttataaagaaataggttcatttggcttatggttctgcaggttgtacaagaagcatggtgccagcatctgcttttggtgtgggcttcaggctgcttctgttcacagtggaaggcaaaggggagccactgcacagagatcccatggcaagaacagaaacaaaagagcacggaccaggcatgttggctcatgtctataatcccagcagtttgggaggctgaggtggatggatcatttgaggtcaggagtttgagaccagcctgtccaacatggtgaaaccctgtctctactaaaaatacaaaaattagctgggtgtggtggtgggcacctgtaatcccagctacgcaggagactgaggcaggcgaatcgcttgaacttgcgaggcagaggttgcagtgagctgagatagtgccattgcactccagcctgagtgacaagagtgaaattccatctcaaaaacaaaaacaaacaaaatgagcacagggaaggtgccaggctctttttaacaaccaactctcaggggcactctcatgggaactagtagataaataattcattctttactgcaaaaacaccaccaagccattcatgagggatccactcccatgaccaaaacacctctcactaggccccacctccaacactgggaatcaaatttcgacctacaacttggtgaggccaaactatatccaaaccgtaacaccctcttatttggtcagtcactactgctgagaggtgggtggaataattcttcattcagcattaaacaagaaaaaatagatcctctctgaaattgcccatgtattttgctgtgctttaaaaaagacttgtagatctattaccacttgtaaacttttgcatatgtgttcttttaagcatttttcttttttttttttttttttttttttgagacggagtcttgctctgtcgcccaggctggagtgcagtggcgggatctcggctcactgcaagctccgcctcccgggttcacgcagcatttttctttaacactcaatagagtatcttcatggatctaatgagctccaatatttcccatctctccaaccctttttgtgcttgtgttagtccattttacattgctgtaaagaaatacctgacactgggtaagttgtaaaaaaaaaaaaaaagaagttgatttgtctcgcggttctacaggctgcacaagaagcattgccccagcatctgcttggcttctggtgagccctcaggaagcttctacttgtggtgaaaggcaaggtgacatggcctcccacatgacaagagaggaagcaagagcgagaggagggtggtgccaggctctttttaacaaccagctcttgggagcactctctctggaattaatagagctgaaactcactcattaccgtgaagacggcaccaagccatttataaggatccacgcttatgacccaaacacctcccactgggccccactttcaacactgagggtcacacttcaacatgagatttggagaggacagacatccaaactgtatcagtgttcttgtatctgtggagcatcagaatcaccaagatggatttttgacaatttcaggttcatagctcccacctacagcgcttcctggaccgagagaaccccctccgcaggacctggtaactgtgcagagctcttcagggcttccagggagctgccatgtttgggccctgctgacctgactttgcagagtccctgctgcttctttgagggagggaggtgtgatgagaacagtgatgttgatgaatgtaaaagcacttcgcagactgcagctctccgcacatcgccatgggcaccctctgctttcattcttccattctgcgattcttcctgatttctatgctttttctagcacctcactgccctgctgccgacgcttctgagatgaaagttgatctcaatccttgtcattctgataacactccagcttcacatcttgagataattccaaggttccttttatctgacttgcagatggatttgcaaaatatatgtaattcatttatcacctaggcttgacctggttacttctaccatgaggtaactagggctctgaaactggagttactggtgcttcaggtgagctatgcctgtgcccctgtgtaacaccaaggagcggaacctgaccccaacaggcaagttcatgggaggaatatcagcttctctgtgcttcttttcttatggatttttccatggcacatatgggaagtggggatcaaatgaggtcttttctgactgatacagaattgttttcccctacaggtttttgggggcatagttccaagcacactggcaattttgcctcattccttaatgcagaggtatcatgcttttcaaaatacagaaaaacgccactgaattttactcactttgatcctttactatctgggcttttttttttttttaatagactttattttttaaagtaggtttcatttcacagcaaaaccgagtggaaggtacagaggtttcctgtacacccctgatcccacacatgcacagcctcccttgttatcagcatcccccgcaagagtggtacatttgttatcaatgaacctgccttgaaagatcattattacccagtggacatagtgtatattaaggttcactctgggtgtttattagtttccttgaatatttgaaagactcaaggaatttccttctgaaccagttttccagccaaaaggaaactggcattttttaaaaactaggacattttctctccctttatcctcttctcttttttccttcccactcccctggtaggtctgaggtcccttaaagttgaggtgagggtgggaagagacaggtggggacagcagagtcaggtgtggtggaagaagggagggcagaggaccagctcgtgttccatgtaccaggccgagaagcatattcgtgtctgtgggttcgtttgtgggttatagttccgaaagttgatataccacaaatacaactctctggaaattgaacagccagatacgaaatcaatggaaatcaaacccagtctggaattgttaatataatctgtcctcaacccagaaaaagcagtgagtgcttcagatggtacaatgtgtactggcccctggtaacctttgcgttgctggctgtgcccaggatgtttatttcttttgccttacatttataaaatggatctcttggaaacttcagtactggttttctaaacatccttttgtgattctactttgtacttgcctgaattctgaagtgatctttcttcaatagttcattcatagtcagtcatccttgatctatatatatttttttactgattcctaaaattttttggtaagtttaattcatctctcatctagtaatgactttaatagtctgttgcaaatatcggattgcttttccattgctcaaatatcagtgtgcagtacatataaaggcaattcctttgtttaccaaaggacagttcccactaggttaaatctattgctccatctggcccaggggatgggttctgttcacttagtgtttccaaatatagggcactgtgttctagacactcttgcttctagtaaggcaatgttcaaaatatcatctcaacttctagtaagtacttattagtaaaacgcagatgctctctaaccagagctcattttctccaggtcttatctttatgtacatagtatatgtacagaatcccagtgactgcaaattcctggaatatgtattatgtgtgtttatgtctctaatttgctatctctccttgtatgcttaatgttgaactttaaaaccactttttgggaattgttacaaaagctatgtttactacatactatgtgtatatatttataatacataacctaagaatgtgttgctcttgatcctttcggctgggactgttagttatcttggtctctgaatctggtttctgtgtatgtgagtatgtgtttatttgtatattttgtcccatttttggactcacagaaaattaaaaacctgcaaaccgaaactcaccgtgaaaatatttgatataggtgtttttggatgcattttaaaaataataagtattctcattatttaaacactattgtaacacttcagcaagatgcagatttaggcctgaaatcaaccactggaatatatgaagaagaactgatttatggatgttactttatagagttttattatacacagtccccaggactatatagccaatcccagtagggcttaatcaggtaccgttaaatactgggctttaggaccataatcctaaactgcagaatgacatttatctaaagtaattaccttgtgactcaaccacatttcactagtatttgctaatctccctagcatatgggatctgggaattaaaaataagcagatcaaataaattacattttatggtatccttagaggatacaatttgactttggaattgaaaatatgtttgattgcgttactttgttaattttttttacaaggaaaaattaaaagaaagaaattcttctatatgaaaatgttactgtatagctttaaaggcagtaagaataaactcgtagccatgaattaccaaactcaatgcctttttgtctgtttccagctaacacctgtgtcccctggaaggcttgggtagcaaatgtgcccacctaacagtgggaaaaatagcttctgctgggctggcaaaagcagaaagtcgtattttggaaagagtgaagaaaaatgtcaatgctgacctcacactttctcccagtttctgtccccatccccactcccctcctctcacacctgggaggaagtgagaaagttgctacagtttaggattatgaactttggaataagacaaacctgggtttgaaacctggcttgcccactaactggctaagcaaacctggctctgctgtttgacattcctgagcccctatttcttcgcctgtaaaacagggatgagagtgtatacctcaccagtttcagagataagatttataaaaggtcctaggtgaacacttctggctcagagattgacacaaagtgccataaacagctgctcagcccatggaactagcaaaaggtggtctcagtcctgagggtggggactaaaactaggtttcccgccacctccttgaggctgcagcgcattccccagcttctgccagaggaccacatatgcttcttcgtttaaaggattctcttacgatttaaaaggacctgctttatccagagtcctgtcttctttttcattcccattgatcatttgtgttttgctgagatgtttttctatactatattattcgtctttttaaaaacaaaacacagctttcattttcaattccttgttgttttgtattttatcatctttcttcgaagtcctttcagtttactgcattcttctcgcttcttaaattgaatattgagctaatttgtttccagtctttctttttcaaaaaagaaatgcatttaaacctatacacttctttctaataaacaccatagctatgctccacaagatacttttcaaaatctgttattgtttttctttagttagtcatgtaggtacatatatttttcctttggcttctggtacattgggtgttttccacttactgcatttggtcttggattgtcttccagcccacccgcctttcctgtccccattagatgattctctatttcctttatttcttctactggtgtggaagtttatataagttctattgatttttttctactttccatgctcttttaattacaattttaaaatctaccttctttttaacgttctcagtagtctgttttgtttttttttgagacagagtctccctctgtcacccaagctatagctgtagtgcagtggcaccatcttggcacactgcaacctctgcctcttgagttcaagcaattcccctgcctcagcctcccaagtagctgggattatgggcgcccgccaccacgcctggctaatttttgtatttttagtagagacggggtttcaccatgttggccaggctggtcttcaactcatgacctcaggtgatccacccacctcggcctcccaaagtgctgggactacagacgtgagccaccccgaccaggcctcagtagtctttaaaagttaatttaatgtagtcccagctactcgagaggctgaggcaggagaatggcttgaactcgggaggcagagcttgcagtgagccgagatcgcgccactgcactccagcttgggcaacagagcgagactctgtctcaggaaaaaaaaaaaaaaaattaaacatggtaaagttggattctccaaggtagatctagaatctgttattcaccattggttctggtggatgatctgaagtgaagatccgtgtagcacggaccctagccaatcaggagagaggcctgaccatcagctgagtaccctgggccaccacgtggctcacaatggctgaatgcccaccttctacgtgacatcccacatgtgagtgtgacaccctcttagtaccaaagaaaaatcttcacttttttttgtggtgaaggtctgatagtagtacattcttttattcttatatctgaaaacatctttgttttgcttaatttttgactaataacataaatggagatggaatcctatattgacatttattttccttcagaatttttgtaatgattttctagcgacgatcttaactttgtcagtaatctttttctctctgataggttggaatatatttctctggctctgtaatagtctgtagtttcatataggcaagacatgggtttctttcctgcttggcttgtaatctttctagaatccaaggattctggctgtttgtcagttctagaatctccttcagattttagctcttcaaatattgtctcttctttcgtcttcttccaggtctcctattaaagagacattggaatttatcattcttttctctatatctcctaacttttctttcatattgcctacctctacccctctgtgttatgctttgggtgatttcatcaaatcagctttttttcctcactgcttctttttcttctgtgtctactctgaagttttattgaggtttttttttggatctgctttcagaatccaaattaatttattataatttaattatgtacctctgaacttcatatgtattgttgctttcagatgatccaaaaaaacacagacccatcaggtcttttgcttgctttctgtggtgggctgtggtctgtgtgagaattgttcccctttggttatgttgatttcctttgatccctatagcccattccctctacctccctctgtcgttacaaatgtgctaatgtgcatctttctgtgttttgcacaatgcatattgttgttttgtttgcatgtgggtttcaatttacatcatcaagttgtattatacatctttcatcttcatccacactatgtttctggaactcttccatgtcacttgaaaattaaattcctgacacctaactgctgcactgtactctatggtctctatactgcacattttatgtatccccattcccagggatggattctaaaactgaccaacaaccccatcatacatcttgctgtgtccataatttattccttcctatgggttcttgttctcgctgacttcaggagtgaagccgcagaccctcacagtgagtgttacagctcataaaggtagtgtggacccaaaaagtgagtggcagcaagatttattgtgaagagcaaaagaacaaaggtaccacagtgcaaaaggggtcccacgctgggtgctgctgctggctccagtggccagcttttattctcttatttggccctgcccacatcctgctgattggtccattttacagagcactgattggtccattttacagagtgctgattggtccgttttacagagtgctgattggtctgttttacagagtgctgattggtgcgtttttacagagtgctgactggtgcatttacaatcctttagctagacacagagcgctgattggtgcatttacaatcctttagctagatgcaaaagttctccaagtccccaccctacccagaagcccaactgacttcacctcctattgctacagtgaacatccttgaacttgtccctttctgaaggtgtgtaagagtgtctctgggctattcacagaagggtttaactagatactgccggatacctctaggctgtgacggtgttagcctgcactctatttttctcagtgcatgagggttcttctgttcctatatactcaccaatccttgcaaatacctggttttctaatgtaatgcccaactttgtttttactaactctgtttttaggcttgtttccacctgaattgattctcccttagctaagagagccagatagactccatcttggctctttgactggcagccccttcctcaaggacttaacttgtgcaagctgactcccagcacatccaagaatgcaattaactgataagatactgtggcgagctgtatccgcagttcccaggatttcgtctgattgataacgcccaaagccccgagtctatcaccttgtagtagtcttaaagcccttgcacctggaactgtttactttcctgtaatcatttatccttttaactttttgcctacttaacttctgtaaaattgttctaactagacccccctcccctttctaaaccaaagtataaaagaaaatctacccccttcttcagggccgagagaattttgagcgttagccgtctctcgtcgccggctaataaaggactcttaattcatcccaaagtgtggcgttttctctgacttgcctggatacaacataatggaggccccagcaagatattaacgccactgggcgagagccagtctcgctccgggctcccccggaaggacagccggctcggaggggggcgccacctgaggaaacaattttcaggtccccaaagagtgaccgtcttccggaggagagcggatcgactaccgtgtcagtgccctaaaattcaacatctgagtcctcagcttctcaccccggggtcaggtaggtcagatttgactttgttctggttctggtaagagggaagcggcctggtcgccggctaataaaggactcttttttttttttttttaataaagcttttgagtaaataattttatattttcaaatttctccataataagggatggtgaatgaatatataatacataaataaatgaatattcatttatatatcattacatatattttgttcataatatatgaatgaatggatgaattaatttataaatttatgatatataaattcacatagaattttcactaagataccctctcgtgccctttccaatttgcatcttatttttttttttattttattgttattatacttttagggtacatgtgcatgacgtgcatgtttgttacatatgtatactcgtctcaaagtgtggcgttttctctaactcgcctgggtgcaacgctaattgttgatagatgcaaaggtataaaaagatatttcgtgatcttagccctttttatgattattagttaattctaggagttttgaaataatttatttgaaccttacgtaaaaattgcgcatttatatcttttcattgtgctcctatggggcttcctgtcttcttctgttggatttttcaggagttctatatatatattataagtattaaattttgttgattttagatgttgcaggtgtcttctcccattctgccactatcttaacttgtctctgttctcctgtgttaaacagaaactcatggtttctcttaaatgattttttgaattataatttatatacaataaaaggcactgatcattttttagcttaatatgttttgtcattggaagacacccaagttgacaccacctaaaacaagatgtagaacattcagttaactgtccccaaagaagattcccttgctcccataattatcagtgtcccagcctgcacccaacccagatgcaatcctttctgatttgaacacaaattagttttacctgttatgtaaatagaagcaagtggtatgtattcttaggtatctgatttcttcttttaaattataatacttctgaaattcacacatgttgttgctgatttcagaactttgtttcttttctaaacatttttcctattctgttgccagacttttgggctgtttccagggattgactaataggagaaaggctggtatgaatatttttgtagaagcctttttgtgaacatatgttaggatttctcttggggaaatactaagtgggatggcatgtttaactttataaaacttctaaaaggtaccacttaaactcttgccagaaatgtatgatagttcttgttgctccatattctctccaacttttcatcccaacagtattttaaattttaaccaatatagtgtgtatgagatggtattgtattattgtttaaatttgtctttatctaattactaatgatgctgttacatgtgctcattggacgtgatatgtcttcttctgggaagtgacaattcaggtcatttgcctaatttttcttgggttgccttcttactactgagttgcaagagtttttttttttaatatattttgggtatgaatcttttgtcaagtataatattttgtttttaatttgtagcctgcctacctatttattagtgatgcctttcaattagcaaatttaaaaaattgatgaagcctaattcttttatttttctctagttaattttaacataaggagttgagtcggactcaaggtttatttccctccatctatttatctgattcttacaatattatttatgaaacaggctttcatcccctgtcacctaattggctttgcaccttgatttttaaaaagagccgtatatgtgtagatctctattctattcccgtaatctaattgtctgtcttatgccaaaactacactgtcttaattatatatgtttcattcgcgtccgtgtgaagagatcaccaaacaggctttgtgtgagcaataaagctttttaatcacctgggtgcaggtgggctgagtccaaaaagagtcagcgaacagagatggggtgggactgttttataagatttgggtaggtaaaggaaaattacagtcaaaggggggttgttctctggagggccggagtgggggtcacagggtgctcagtgggggagctttttgagccaggatgagccaggagaaggaatttcacaaggtaatgtcatcagttaaggcaaggactggccattttcacttcttttgtggtggaatgtcatcagttaaggcaggaacaggccattttcacttttgtgattcttcagtaacttcaggacatctgagtgtgtatgtgaaggtcacaggggatgcgatggcttagcttgggctcagaggcctgacaatatggttgttctagaaatcaaattgtataattgttttgagatggtagtgattactaatgttttattgcagtcttaaaaatcaggtaccttagccaggtgcaggggcgggcacctgtaatcccagctacttgggaggctgaggcaggagaatcccttgaacccaggaagtggaggttgcagtgagccaagaccctgccattgcacccagcctaggcgacagagcaagtctccgtctcaaaaaaaaaaaaaaaaaaaatcaggcaccttatgtgattctcttttttgacattgtttggcttttgaaatgtattatcttgccctactgcactacctaagacttcttgaacaatgttgaatattgattagaagtgactaaaagtgatgagtgaatacctttgccttgttcctaaccctaaggggaatgtttccaataattcagtgttagatatcatgttatttgtatatcttctgtaaatgccctttatcagattgtgaaagttctcttttattcttagttttttgagtatttctcataaaagaagctgaatgttgtcaaatgctttttctacatgtattgagatagttatataatttttcttctttaatctgttaatgaaatgaattattttgactgatttttaatgttaagccaattttgtattagaaaataaacttgacatggtcatgacctgttattctttttaagtttatagcatccaattgctaatattttaatagatctttgtgtattggaccataagggatatttttcttttttcttaaacttataatgttttttgtaggtttaatatctgggtcgtgcagtctcagaaagtcatttgggaagtgttccctcctcctctattaaaaaaaaaattgtgaaggattggtaattggtattacgccttccttagatattgacatctagtcaggagttttttcttttatgtttttgttttattttatgggaaggcttctgattacaaattccatttctgtaacaggtattaggctatttagatgttctattttttcttgcatcagttgtgataagatgcgtttttaaaggaatctgttttatataagtggctgtatctttaatggcataaagttgtttatgatattcccttatttttaatatctgtagaacctggagagatgctactacttttattactgatatagattcttttcattttttcttgacaatttttctagaagtataccaattttattaaactgtcttaaacaaatttctcacattgttaattttcttttatgtgttttcattttatttctgctgtttttattatttcctttcttatattttagttgtttttcttagcttattaaaagctaaaactttttgttttacaacttattattttcaattcaaatagggaattaaagctatgaatctccctctatgcaccaccttcactgcctttcacattttgatatgttgtgttttcattttcattcaattcaaaatatattttatttttccctgtggtttttctataggtcatcatctgtttagaaacatgttgtttaattttcaaatatttgagtagttttaaagctatttattttcatttatttcaagtttatttatttatttatttgagacagagtcttgctctgtcgcccaggctggagtgcagtggcgccatctcagctcactgcaagctccacctcccgggttcacgccattctcctgcctcagcctcctgagtagctgggactacagtcacccgccaccgcgcccggctaatttttttgtatttttagtagagacggggtttcaatgtgttagccaggatggtctcgatctcctgacctcatgatctgcccgcctcggcctctcaaagtgctgggatcgattttaatattattgttttcagctatcatactttatatgaattttatcattatgatttgctggggaatttttcatgttgcagaatgtgattcatcttagcaagtgtttcatgtgatcttctcaagaaattgtagtgtatagttgttgagtggagtattctattagagataattatgtaaattttgttgacagtattaaaatctcctatgttctttgatttttggtctacttgttttatcagttataatgagaggcatattaaaatcttccatggtgaatgtgagcttttcaaaagcaacattcttcctttagtgctgtcaagttttgtatcatgcattttgaatctctttattaggttcatacacatttaagataattacttcttcttgatggagtgactcttagcattagaatatactcctttttctctctgggttactatttgtcttgaattgtactcggtcagatataaacatagccgtcgagatttatgatgcatagtggttggatagtatgtcagttttcaacattttattttcaaatatctatctctttatgctctaagtgtttcttgtaaaagtcatttatttgaatcttatttttaattagtatgtaagtggtatttcatttatatttaatgtaattatcaatacaattgtatttaagtattttaccagtatttgtttctctttcttatttcctgccttattttgcataatccagcaattaactttttaaatatactttgtgttattttttaggagtttgctagaaattacagtatgtatacttaactatcatagtctaattttcaattatactaaactttaaaaaaatctaagactatcacaattatataattctattctctcattctttgtattcttttgtttcactgtattctataaaacttataacacattgctactggttgtgctgaaatgcatatatatgtacacacaaacacacacacacacacacacacacacacacacccacacacacacatgttgagtatcccttatcccaagtgcttggtaccagaaatgttttagatttcagatcttttaggatttgaatttgcatttgcattatatacttagtagttgaacatccctaatgaaatgtgcaattctccaatgaggatttctttggaatgccatgttggatctcaaaaagcttcagattttgggccaggtgcagtggctcacacctgtaaacccagcactttgggaggctgaggtgggcagatcacctgaggtcaggagtttgagaccagcctggccaacatggcaaaacctcatctctactaaaatgggaatatttcagattttggatatttggactggggatgctcaacctttaatatgtgcttaatatattatgcaacatgtatgtctgtatacaaacaaacacacatgtatattaaatataataagtaggtcctttatttttacctatatgttatactacctatgttttcattctttcctgcagatttgagcttctatcatgtatgatattctttcagcctgcatttctttaagcatttcttggagcacaggttttttggctaaaaaaatctctgagttcttctctagctgaaaatgtctttacttagctttcattttcttaaactgatacatattagatgtccatatcttcaggatacatgtgattttttgaagcattcatatcaagtgtaaagatcaaatcaaggtaattgagatatctatcaccttgaatattcatattttatttatgagaagaatatttgaattgctctcttctatagcttttatttttttatttatactttgactaaatgtagaattcaatgtagaattctatgttgacagttttttttcagcattttgaattttttttccattgtgaggaactcatccatcattcttttcatacttcccctaaatataacatgggctattttttcttgctacttttaagatttcttttcaatttttttttcttttaaggttcacctctgatgtacctaggtgtgattttgaaataactttttaaaatcttatgttgtggtttgctaatcttcttgggtatgtaccttgctgtatttccttaacttaaaaaatattggctattgtctcttaaaatattttttctcctgtatctctcttcttcttctgggattccaattgtttatattgattgatatttttacacaggtcttggatgctttgttttatttttttcatgtttaatttctttgtgttttattttagatattgtctattggcctgcctttgattcttttctcttctatgtccagtctgctattaagcccatcaaatgaattcttcctacctagtatcatacagttacgtcctgatagttccatctgagttttgctttcaccgtttgcttcccatgctgtagttcttcacctgttcacacgtgtcagtattttcctctagagccttcatcgcagctacaaagttcctgagtgataaatcaaacatctgggccatttccatatttgtttctgttaatgagttatcttttaaacatgggccttgttttgttgtttctttgtgtgtcttgtgactttctgttttatgctaaacattgtgtgcagattgaagtaaggaatgtttaccttgcccttgcaggaaggacatgctccttctgtccttctgtcgggctggtgatgtggggctgagtcaatctgacatgtggctgggctgtgctgggctctgttgcagagttaggatcctgagctagattctctttaccttgggttcacatggtgtgaaggtggggtcagcactttgccttcagaagggcttgggatctgagcaccagccagactctttgaatctttgtgctttactgaccagtaaccagctttccaaactgtgggagatctctttctgctttacagcttgcctgccagctctttgagtttctggggcattctctttgctctctagacctgttcttgactttctgtacctggggagatctctttttgcatcaatggactgccctcagcctttgaaggccactgcagggtacttggggaatgcagagatccacctcagttctcctgcactcatcccagcttttggcattcattttgttcactacatttgtccttgcttccttacgttcataccacaaatttttttttctgctgtttgctaattctatgttctatatattatttttatattttaaatttatattttgctctcttgacatctgaaatccagtgtgaacacacaaaaaataagtaggaaaaactccaagtttcataaaccttacctaaagaagtcatttctaatttattcataattgaagctcctgaaaggtctgatacagctctggtacaagggaggtatgtcagtcagggtccaccacaggcacagaaccagtaagttatataggggacagatagaaatctgaagaggaagcgcttgaagtgtttttaggaattggcaattgctgtagcaactatggggcggggctgagagtgtctgaaatccgtagggcaggctgtcagaaagggctggctagaactcccaggcaggagctgatgccgcagttcacaggagcaattttcttctttctcagggaagcttcagttttcctcttaaatcttttcgactgattgaatgagggccacgtaaacgatcaaagacaatctcctttacttaaagtaaattgattacagctgttaaccacacctacacaataaccttcatagcaacacctagataagggtttcatcaaataactggaaactatagcctgacccagttgatacataaaactgtttatcacaagagtaagggtctattccacagtgtggcacagtatgtgttaaagaataaactgtaaggaagaaaataaatggaagcaagaaaatgaaagggctgtgaatcctgacatcatccaacagcaaggcaccctggggccagctctcctgcacagtgggtaggtctgtgtccagttgagggaccctcctgcacccagtgactctcccttcttgtaagccccaaagaaatgctactaggcagggggataaacagcctatctgggattaggcatcagctgttactggagttgtctgggacagccagctgcccagcacctggagatgctgaggcccatgggaatatgtgggccctgctgccaagggaagaggcctcctgctacagccctcgtggtaacagaaaggaggacccccttcttccagttggctcattgtctagcctgccctgagtgagctcctggggcctctctcacatcattctgcccactgcacaaaattgtctgcttatagggcagacattaaaatgctggtattttattctcaaagtgtaagattattatttatttttattttgcctttctacccatctgtatttactaaaacttttactatgtgactatattaattctataataaaaatcaatataacttccagcattttaaataaaaatggagacaagtttatattccccgaggaagaaaatatcattttaatattttgtattttccataagtctccacatataaataccttaagcatctccttgaatgtacagcctggagtgtttctgtgcctgcagtggtctgtgggaaggacaaaaaacaccctaagacctgggagaactcctttttggaggcaatggggtagcttgtataatcagaatattggaaatgattaatccaaattcattgtcttttttcaactagaccagcaatcttaaagaaaaaaaatatatatatttgaaccatactaacacactgtgctttaataaggatagacaagtaactttgctaatatgctctctttctccttgcttcttgggaaactgtcagaatggtataaaatttagataagatgttgtgacttagaaaagaatttgatacaggaagaagggggtggtacacatgcattccccattcattgctaaatgcttcaatcaaacatagtttacgtatcagaaatggaaagaagaagagacaggaaaacatactgattatctacactatcaagaacactagaggcggaggttgcagtgagcggagatcgcgccactgcactcctgcctgggcaatagaatgagagtcagtctcaaaaaaaaaaccaaacaaaaaaacactagatcaagagtggtagttttgtagagaataaattcttatagaaaggaacaaaatatcctaaagactgaattttaatgtttttgaaactagtgtttctgataattttcaaatccatgccatttaacgaggaataggcagagtgcttatgttatgcctgatgctaatctaagtttgggaatgctaacacattagcaaacaaaacatcccagcccttgaccttgtggagctggcattcccgtgaggggagacagatgttgggcctgatgagtaagtccattgtagaatatgttcagagtgataagtagggggaatgagatgaggaggggcatttggggcgtatggataattatagagacagatgtttgtctgtgttccttgaagtggggcttctttggtttagtgcatttactagtggataactaataaaaaacggctgcagtcccttgagccttatttcacttggatgtccattgtcttctagagcaaattgttattatttggtgtggagaggagatgcggaaacgcagagctctggctgtgtcctgagcactaaaccaggcactttcatttccatttccttcgtcttagcaaggaagacaaggaggcattaagcagctagctaccttgcacaaaggccgttcaattaatgggtggtggaagaccgggaggccccaaagccggggccaactatttgctaggcacagtaagttcagtgtctgaaaccaggatacgttttggagcccatgacaattgttttaatttcttttaaaatcagaaggaaaaacatatgtaatccagcctgattgtatttgtctttatacttacagagtcataaaatgtaacactgatttttggggagggaggacccatgagcatcttaacatggccctgcttatgtgtctttaataattctgttgcctacaccccttctgcttgttgtttcttggcatttctccttcgcactgaaaggatgcttgtgcttacggacttgggtcatcttcaacctgtgtccatccccactttcctgtgtctcacagagggccaatgaagccaaggctgttgtcagcaagtatgatgctcagcatttggtagggtgcaacacatatttgttcaatgagtgaatgaatgagcaaatacatgaatacatgagtggaggaacctggcaatagcagtagtggtgggtggggggatatttacttctcttcctagcagactttttttcaaagaaatgtggcatcagcccactgaatgttccagccaatgaaattattttcaaagcattctgtgtcacaaagcccatatggctctgaactaaagggagaattagaaataatctgaaactcagttaaagataagtttgctaaatccagtgcatgatgaattcaaattacttttgcataatgaataatgtgttgggtggtgagtagcggtgtgaaaagctaaattgtgataaacgcaagcttgcaagagtcaatgaatgtctggagagtcttaaactacttaggtgcagttgaaggtcaaaagttcagcaatgtctggcagagtagatcacatgggattctcttgattatgttagtaagattttatgatattactttcagtgtcttgtcttctctggatgatggctggtaagcatgtttcaggccatggcattcttgttatgatgtctccagagagactccccagcatcactagccatctagggtggccgtttctgagcgtcaacagtgccaaagcttctgccctgtctcccaaagcacatgcttacagcaggctaaggagaaaaccctgaaacatgaaatgtaggacaataataatatatgtgaaagaggaaaaaggatgacatcttaatgactgatttagcagagagggtttacagagtttggcttacgtctagacttaaacccttttggtttgagaagtcatgttttagttatctttatgtgccgtttttcatgaagcttctcttggctggggtgtaaagttgatataaaagggtacatgttgttggttcatgcgttcatgctgggggacctgcatgtgtggaaatgacaggagtgacaagagtccaattttacaaaataaactgggactctgaagttttggaggcagacatttgtgattccttctgtgtagttgaaagtgattcacctggcggtattttccctctgttgaagttgaatccccctttccatgtgatgttaaggatgcatgtggacaggcaatatggcccttcttcagataagacactctgggctgctggctgcggttctgggacatcttgaagcccccgaggcactgagtgtgaacatgtgggtgctgatgataattcagaagctatttagaaggtagggacagcaatggaattttgtggaaattaattccaatgtaagtgtgatatgtcacttatccaagggtgttccttatgtgtgacctatttctatgacatcagtggcatgaggcttctctgtgaacatattaatatcttggcattctttggttgagattagcatcagtcagaagctgtggataggctagagtcagctcaaaaacccctgatcacctaccctgacccctgagagtttattacgtagtcacagatggcttctctgttctataagagtagaacttcctcttcatggtcttcttcgagctacagtgtctctaatttccctaaatggctgctcaactgtcaagagatgtaagccctattagccgcattggccattcagctatagacacccagtagccatggtgggtagcagagcaggtctggctggagaggagaagccagtacctcggctactggaaggcagcaggcatacaaaggctgcacttcttggctcctgtcttatgtctttactttgttgtcttcacaacatggccttaaagtattttggaaatggcaccgtgttgggtcatgtgtgtcaggggagcagtatcctcccctccacctctgcccatcccacctgggcctcttcccttccaatctccaggtgctcaccttggaggcacagggagcaactaggtctgtacagcacaccttgctggcacaccagttctccttattgccaagcagcttctcaccctaattaggtattaaaataaacttgcatttgttatggaaagaatgtggctttgtgtgtttttaaggcaagacacaaaattttaggaaattttatttcttgactggcagaataggacacagaagggtctagccttggcaggttcccgtttcacgtgctcattccatttagtcttgaaaacaatcccatgagtagagacagacctagagaaaggaacaaagtggctcaaagtgacctttttgtaggaggcagggttggcaggatccaggcgagatacttggtgctgtcctcagccctaagtccatgccccaaaacaggtcaaaggaaggccagaagtattgatagagaagtagaggaaggaggagggtggtgggaggtcaacgctgagtaaataaagcaacactgcctcttccctctagcttctttgtgtgcatagtcagaacaatttctccaaatttactctgaagattagttactggcatccgtgaagaacttggaagggacaaacgtaccattgttttcatttttgttcctcacaggaaaattcatactctcaaaatcattgttttttcccctgcagtggtctgttttgtagagttccctaaccactttgtttccagtggtaactgtgtactttcctctgacacaagattttaaggaaaagaaactaccaaagatgttttatgttgatttctttttccatatttaggactgctgaccaagcacatttattgtggttatcattaaatgtttgacatttacaaacagcagggcacagagtacgcatctctcagatgggcgggaagcctgagaaccaagggctttcagccgcgtgccttttgcatggctggccttgctcacagctctgctctcactctgcctcccttctcccctgaaatgtgctttttcataggaggctctttctgttttggttttcctgtttttatggctctgcttctaaacatataactatatataaacatataaacatatataaacatataaacatatataaacatataactatatatacacatataactatatataaacatataaacatatatataaacatacaaacatatataaacatataactatatataaacatataaacatatataaacataactatatacacacatataactatatataaacatataaacatatatataaacaaacataaacatataactatatatacacatataactatatataaacatgtaaacatatatataacatataaacatataaacatataactatatataaacatataaacatatataaacatataactataaacaaatagatatattttgttttacaaatttttattttgttttatacatatataaacaaatatatatatatatttcaaaatatagatagtattatcattgatctggtggaactctgagaatttctggattgaagttctcagagttccaccagatcaatgataatactacctgtatttcaaaatataggtagtatttctgctgcttctctatgatgtgttagtagtagatctcttgatctcaggtgacttcaagctgggagacaaactatctttgtttagcaaggacagagaagttaaccagttgcatgactttcagtaaaaaaaatgagagagtcctggacaaaccaagacagttggttgacctgtgagtggtttcagtgtgcaagaacacactggcagttttgacattttgagatgtggtggctctcctagataataaactgtcttccacttctgtgtaagcttttcttagggataactcaccctgcttcagcaaatccgggcgattgtctctatcagccaaattctgcacatgtagcctctgaatctaaaataaaaattgaaataaaaagaaaaatataagatgctttgtttttgcgtctctctctcctagccgttgacttttagtgcatgtcgtgcaggcgacagacgtattgctgccctttctgtctctggtcctttttctagggcaggatccaagtagtttttgtgagcattgcagccagggatcatttcctctttcccttttagggccacaatagtgacctccagcagcactgggtactgaaatacagggctttggctttcccaggctcatacacatagcagagcgtctggtttaaggtctgtataattttgtgtaattatattcaattgctcactcaatctctgatcactttctaatgagctgttattttcagaggtagtagaaaaatcagttcaggaagagatgatgatgtgagagaaataaatagcaaatgactagtgaggagaaattacacagtaaacatgatgctgagctttctctgagtgagtggtgtgtctagggaggtgtattatgaagtacattgctatgaagaacggcctgagactgggtaatttataaagaaaagaggttaattagctcacagttccacatggctagggaggccccaggaaacttaacaatcatggcggaaggggaggcaggcacatcttacatggcctgagagagaaggtgagagagcatgtgagagtctgggaaaaactaacatttataaaaccatcagatctcgtgagaattcactcactatcatgagaaccgcatgggggaaactactgcattgatccagtcacctcccaccagctctatccctcaacacctggggattacagtcaagatgagatttaggtggggacacaaagcctaaccatatcaggaggggtgtgttagttgagcagacacagaaaagcaaaacatttgagcccaagagtggaacccatcccttataaggagagaccacgatgtggggaaagtcagtgaaatggacatatggctaagtttgtttagtgtttgaaaatgtcaccgaagtcactttttaataatgaaaaatatgtggattgaagagtttaaaagagaagtatgcccagatgttattttaaaaattggagtgtatacaaagggcccccaaatctaggctgccttagtatttttgcccctagctttgttttcccttaagtgatgtcaggaactgccagtgttggcctctgcatctccaaaactgaagacagcttagttcactcggtctcgtcattattgtttcatgaaagcatgtcgttgggagatctgggctcagacctaagattgaaacaaaaaaggaaagagaaagataagaaaaccgtctcattttcaaaaaccttcacaaaccccacgttttattaaaatataaaccatttgaagaaaagccagaggaaaatagaggaaatggggtatcactgaatgaagcagaagctaaaggatgatcatataaattgtctcaaatagcaggtcaggaaccagtggcctgtcaccatgaaaacaaagttaggggaaatagacaaatgaaaacaagtgagtttacattattcctaagaactttctgccggtgagaaaataatggaacgacgtgtagtcagcatacacacaggaatctatattttgtaggttatatttcaaaggattcatgtaccctgaaaagaactgttgactgtagggtaagttaacaccagggggtgctgggtgcaggcacattgaatctgaactactgggttgccattttagactgttaccatcatcactgttaccacacctgtagtttaggtcattagataggtgtggaaatgaagcctggctccttatcaatcgaaagcctatgctcttaccaaatacactatgctatttaatattggtaatattagtgaaatttagccgtttcagagttttccttctttccccaaagcatcatttgtcaatgtttgttaacatacgacacttaatgtaatcctcataaacaaagtggacaccctcaagttgttttctgggatttttacataagcatatggtccttgagcaatgatggtttgactttactatgacaatatttggctttaccgtggtgtgaaagtgatatgcattcagtagaaaccatacttcagatttcaaactagatctttacccgggctagcaatatgtggttccatactctcttttgatgctgggcagaggcagcaagctgcaatccccagtcagctacactgtcacgggggcaaacaaccggtactctacaatgcattgtgttgccagctttttttggatgtgattttgcccaactgtaggctaatgtgagtgttctgagcacatttcaagtaggctaggctaagctatgatgttcagtatgttagaggtattaaatgccttttgacttgtgatattttcaacttacaatgagtttctccagacataatcccactgtaagtcgaggagtcgctgtattaacaacgggtagactgaaaacaccgatgtgcaaacctggttcagtacggatggggtggacatcggcatcagggttcttgtgaatattccccgggaacatggggaacgtggtgttgtgaaatctagagctggccaggaatttccggatccttacctccagctttccaccccacacagggggtccccctggagccacctgcctacctgactgcttatcttccagcctctgtctgagcttctctaggtaactcctacatccagggcaactaatttcctggagcaacagaagagccttccttgtattgagacaacatgcatggtctccctgcaaatgctgcctctctgctcctacatcttcacattttagtgtagaaagagcaatcgtgggtgagaatttaagcacaagtgtttagttcaaaagacagaaaattggccacgcatggtggctcaagcctataatcccagcactttgggaggccaaggcgggcggatcacgaggtcaggagatcgagaccatcctggctaacacggtgaaaccccgtctctactaaaaatacaaaaaattagccgggcatggtagttgggcgcctgtagccccagctactcgggaggctgaggcaggagaatggcgtgaactcgggaggcggagcttgcagtgagccgagatcgcgccactgcactccagcctgggagacagagcgagactccatctcaaagaaaaaaaaaaaaaaaaaaaagacagaaaattttaaaagcatcaaaacagccgttacagagagggaaaaaaagttcttaagtatcttagaactgcttcatttcaatagatgttgcaataagctgacttctatatgacttataggtcccgaatcattgatatttatgtttgcaaatttgtgtgttttgtgtaaatgagatcccagaactacaacataaacttctaatgaactctgtttctatacctatgtggatcctgagaggtgctcaaatatgagaggctgtttctcttaacctcctattctgcttaaaatcatttgtctttacttgtacttttttttttttttttttgagacggggtctcgctcttttcgcccgggccagagtgcagtggtgcgatctcagcgcactgcaagctccaccccccgggtttacgctattcttctgcctcagcctccccagtagctgggactacaggcgcccgccaccgcgcccggctaattttttgtatttttagtagagacggggtttcaccgtgttgaccaggatggtctcaatctcctgccctcgtgatcctcccgcctcagcctcccaaaggtctgggattacaggcttgagccaccgtgcccggcctactttaactggagaattcattcttccaaatgtgctcattcatggttttattttattttattgcattggattgtatcattgcatctcctacctgtgcattttaagagtttccacttcaaactttgtttcattatgaggtaaaccttaaaaaataaagcctgttttctggagtgccacagacattttgtcagaagaaaatgtgactgtcctttaatcgggcactgttttatgcacataatacaaatgatttctgcatgcttatcagatctacttgtgggcttataaattcacttcatcctggcatacgtagtgaaggacattcctctgtgccctgtcaagaataatcaagcttttaaaatcaattccagtggtgataaaaataacgaggatggtttgtgaaaagggacaaaaacttggtaaaaataacattgaaggatttacaatatacagagagaaagtgaaccatctctttgaaaataagtgtaaaaaagaaaagtgtatctaatatttttattgatgcataagctatgaagagaactatcaatgtttctgtcttgctctaaatgagatatgactggtgggatcccagatcatttgattatccgtttgcagactgctctgtttatttaaaacataattcactctctcattctatagatggacttactagataggagtctgtgctttataagtgaaattaacttagataatttttttttttttctttttgagatggagtcttgctctgtcgcccaggctggagtgcagtggtgcgatcttggctcactgcaagctccgcctcccaggttcatgccattctcctgcctcagcctgctgagtagctgggactacaggtgcccgccgccatgcccagctaatttttttgtattttttagtagagacggggtttcaccgtgttaaccaggatggtctcgatctcctgacctcgtaatctgcccatctcggcctctagatcattttaatgacaactgataaagagataatcaaatgataacctgtttttctcagtgatagaaatatgtgatggaaagtatctgagactaatgaaagacatggaaactaatttaccgatgatccttggatactagttatggaagtatacttatattatctatgcaaatatacaaggtcttttgaaaaccttttacatgcccaacgccaaatatattaagtgaagctacacaataagatactgtaggatcagtaaacaggtattgctaacgtttgtagcaaaatcctgttgatccacattgttgggtctttcttggtatggtctagtgagatatcagtgcgtgtgtatatatgtatcagtgcattttagttcattttgtgttgctataacataatactggaggctgacaaattaagaagaggtgtttgcttggctcacaattctgatggctggaaagtttaagattgagcatctgcatccagtgagggcctcaggttgcttccactcatgacaaaaagcagaagagaagtgcgcatgtacagggagattacatggtgaaaaaaggaagcagctgggcatggtggctcacgcctgtcatctcaacactttgggaagacgaggtgggcagatcacgaggtcaggagatcgagaccatcttggtctctactaaaaatacaaaaaattagccgggcccggtgttgggcgcctgtagtcccagctacttgggaggctgaggcaggagaatggcatgaacccgggaggcagagcttgcagtgagctgagatcgcaccactgcactccagcctgggggacagagtgagactccgtctaaaaaagaaaaaaagaagcaagagacaaaagccaaataagccagactctttttaacaacatactctctcaggaattaattcccgagagaaggggaatgcacacctgagggagggcattaatctattcatgaagtattttaccccgtaaccagaaaaacttccacttggccccacctcccaacactgccacactggggataaaattttagtatgggttttggcagggacaaaccacatccacaccatagcagtaaatattgatatacagttgacccttcaacaacatgggtttgaaccgtgcaggtccacttacatgtggatatttttcagtaaaacttacactgggtgtgcctgcctctcctgcctccccttccaccttctccacctctcccacctctgccaccccagagacagcaagaccaacccctcctcttcctcagcctactcaatgagaagatgatgaggatggagaactttgtgatgatccacctccatttaatgaatagtgctatgatatggatatttattcccttcaaacctcatgttgagatttgacccctgatgttggaggtggggcctagtaggaggtattgcgtcatgggggtggatccatcataaataggttaatgccatccctcaggggtgagtgagttctcactctgtgagctccctccagagctgatatttaaaaagattctggtacctcccctctctctctctgacttcctctgtctccatgtgatcttcacacagttggttcccctttgccttccaccatgagtggaagctgtctggggttttcaccagatgcctaatcttgaaccttccagctatcagaattgtgagccaaataaaccttttttctttatgaattattacccagacctctgtatactgtcatagcaatacaaaatagactaagacatatagtagtatattttctcttccttacaattttcttaataacgtttttttctctagcttgctttattgtaagaacactgtatttaatacagataacatacaaaatatgtgttaattgcctgtttttgttatcagtaaggcttccagtcaatagcaaactattagtagttaagttttgagggagtcaaaatttatacatatatttttaactgtgtggggactggacactgtggctttgttcaagagtaaactaaatacatagaatctcatcttctgaatattataaacattattagacgtgtctttcctcaaaggtgattattctatatagtgatttggtttggaggtagaaaaagtgcagagaaaatttaagcaaatattaaacatcactttttcttctatacactctatttttcttactgacagaatttttctggaacatttaacagtatcttctaacaggtacctctctcacccaacttgtcctcaagtaatccccctacctcagttgagctgtatatggtggctcacacacctgtaatcccagcactttgggaggccgaggaagggggattacttaaggataagacttcaagaccagtcaggacaacatagcaagaccccatcgctgcaaaaaattaaaaaaaatattagccaagcatggtggtggacacctgtagtgccagctactcagaaggctaaggcaagttgatcacttgggagcagaaatttgaggttatagtgagctatgattgcactaatgaactccagcctgggtgacagaatcagatgctgtgtcttaaaaaacaaacaacaacaaaaaacgttggtttgaaatttgacaaaatgttctgcattcacatttagaataaacgttttatatgaggaagttaatatgtcattttctataattaaatacaatataatgtgggtttaaaatttcattctgattcttattttggcatcattaaatatcattactcgatcttgatatttagaaggtttcagaagccaattactagtgcctcaaaaactcagtactgtggaaatgacatatcattgggttctggtaatgaggaatgactatttttctttggatgttactatcaaaacatttttataggcatctggaaaatatctgcctgattaaagagctgtgttttaaatgctcaagatcacgtgtgcttttttcttccctgtgttccccaagcaaatggaatgccatctggattctagatttggctttctcatgtaatggatgtgagaccctgagctagttacttaacatcatcaggctttctggaaagtgaggataggaatgcctgaatattgaatttaaaatattcaagttaatcatgtataaactataaagatttttgaaatataaaatatgcatcatttcattcactcactcactcattcttttatttgttaattcatccaccatttactgaatgccttctgtgcactaggtactgggcttggtgctacctactggaaaattaataaaacattgtctttaaggggctcacaatgtaatgggggaaatcaccaagaaaataaacaatttcaataccatgtgtcaagtgttaaattccagtacaacatgttggtggttacaaaaacgtaaaaacaaaaatgaaatattatgggagcagagattacacttagtatcctccagaaggttaccaaaatccattttatattttacatatagtttgttctgtcatcttctaagaatacctaaaaataggaattacctctataattttaaaaaataatttagtgcaatacagcataggaggagagtatgtctccctctatgtgagtggataaccgtctctgtaatatatacttttctgagatttgttactcatattctttactcagtactatattcagtacacaatggaattcctgttactgttgactagatgactgtcgaaattggctcatttccccaaaattgtccacaaggtgaaggacttgaggggtccctgaaaggctaggtccacagaagaactttccccatggtactggccaggggaaaacattcctagtcagagacaagtatttccaggatttaaactatctttccatttttgtaagaatgatagctgccctttcccctggatcttgcacctaagtaagacttagcagaagcagtctaattttattgtttgcagttatgttctaaaatgtttttaattcgtttaatccaacaatttgtcgcattaaaaaaaaaaaaaaaaactaacaatcaaaacaaacagccaggcatggtgatgcatgcctgtagtcccagctactggctactaaggacactgaggcaggaggattgtttaagcccaggagtttgaggttgtagtaagcgttatgacatctgtaaatagccactgcattccagcctggacatctagcatgaccctgtcttaaacaatacctctacaaatgacaacaatgacaagcaccctgattcaagatctgggattttttgtttcctcctccgcttggctttgctctgaggaggataagtcacgtaacctgttgggcctcagttttgtcatatgataaatgagaaaatggaactaggtgatctttcatgaaccttttatttttaacagtcttgttttagtgatcctatgactctgtcacagaatgttaaaaaaaataattcagaagaaaaatttacaggttgaaatggatttgagaattgaagcatgaattgctggcaggtgtttgcaatatacttttgggtgcaaacggatgtgttatcttgggaatgaagagtgagaagcatttagatatcacagttgttggctagaagaggaaggattggttaaaaaattaaaggtatatttggttaatgatatatatgtaaaaatcttatttgtttgcaaagagttagacacatctgaattttcttacattatacattgtaatgcaggggccttcttgcagggccttgggatgtgtcctgtacacaaataactgatacctcctgaaaccttgcatcaggggaatcctggtggatttccacattatcaccacaggcctttcaatataaaatgctgatttgaatgacatactgtcattgagttgatctctaaaagttgctggaaattttcagaagaacttgatcctcagatactacatatgccctttccaaggcataaaaggtaagtccagtggtactttcataaaagcactgcttaaatatataaacaaaaacattttgtggagttctacaatctagaaagaaatgtgacttgtgctgtttcttcttttatttttaaaatccaccaatagaaactgtccctaagaggctttgtcctttaatcctagctgattgttaaacggtttgttattaatatcttacaattcagtgcagatggttttgagcagtgatcagatgaacaaagatgcttagtgatggttcaatttccgggttggatttgcatcctaatcttagtcttaaaaaaattagaaagctgtttccacatgagctgtataatgttttacttttttactacaattgctgtaatacttcagtccttaagcatagaaaataatgcccattattatattgggtgaaatgaaagctttttaagtgtaaaacatgtaattgtagtctcaaaactatttatgtggcatcaattatggtgaaattagttcatgaaggtaggtgaaaatacataaacattgtgtatatgctaattcatctagataagaattttcatgtagatttggtcagctgtgttagatttaaatgtagtttcagatctggttcagatggaaagtagatgaagctgccaacctttggcagcagcacacaggtggaatagctgagatagaataggtgattggtgaagaagatagaaacatttctaacacatagaagatttcaggacagtgagtgtggcacattctagatgtttcccacactgcagcaatgggagatatacagatcttcctcagtaaacccctatttctagactacgtgagtttccagttgaatcagatttgagaaatgcagtgtgctaaaggcagctcttcttaactccctctgtgaacccaaggaatctgtctcattcattggaagggtctaggaagggaagagaactctttttttttttgagacgaagtgtcactctgttgcccaagctggagtatagtggtgtgatcttggctcactgcaacctccaatgcccaggttcaagcaattcttctgcctcagcctcctgagtagctgggactacaggcacacgccaccatgcctggctaatttttgtatttttagtagagacggggtttcactatgttggccaggctggtcttgaacccctgacctcatgatccgcccacctcggcctcccaaagtgctgggattacaggtgtgagccaccatgcccagctggaaatagaactcttacaatttttctgagtttatctctttacatcagctgcctccttactgtaaaccaaaaaatacaagtctaagccccccagctgactgaatggacacaccctcttggccaaagggacccaaggaaacctgaaaaggtagttcaggccatgacaggaacagaggccatcagacatgtctcattatacactctgccttttggagtttagacacgactgagcagcattaacattaaaatagagatcctaagatggacagaaagattcttcatagcaataagataccaaattccaacctaactttagtataatatcacataacagataaagaaggaaatcaaaatattttaccccaaaatatctttccttgccatattttggaaatggttctgcaaagctgtcttttgtgggggaaattttgcacctgtaaggaatccctattaacataactagatctttcatcttccaggccctcccaatcctgaagagattaacagagagtctagcaccttttaaaagtctgaatgggaaacatttgctatctattgtctctaagggcagccacctatgagacttcatctacataataagaacctcagtctccacaaccccttatcttaatccagacagtttctttctactgattccaggtctttagataataattggttggaataattgacaattccaaccaattgtcaatcagaaactctttgaatccacctataacctgtgagcaacacccccaaccacttcaagatgtcctgcctttctggactgaaccaatgtatacctcgcatgtattgattgatgtcttatgtttccctaagacgtgtaaaaccaagctgtaacccaaccacctgcagctcatgtactcaggacttcttgaggctatgcctcaggccatggtcattggtatttggctcagaataaacctctttaaatatttcagtttggcttttttcattaacactacactttttaagtttgacctaaaggtttctctgtacatagtgaactgtcatctaactggacgtgtaaagggactgtaatctacactgtaacaagtagctgagtctcagccaatcacagcatcccagtttcagccaatcacttgcatccaactattcaaactgagctcaaataagcctgtaagcagccctgctgtttctgtgcctctcgtcccttttgtctacctcactttcctttttctgtccataaatgttatcccaaccatgtgacagtccctcagttactctgaacatattatggttctggaggctgcccaattctcaaatcattctttgctcaattaaactctgttaaatttgtctaaagtttttcttttaatagctactactactctagagaaatatccacaaagacgtaatgtgtttgttcggaataccttgttgaatggaaagaagggtctgtcctaagggacaattgcaaggattgagacacttggtggcaattttgaggaaaaagcaatttttttttgagatggattcttgctctgtcactcattctggagtgcaatggcgtgatctcggctcactgcagcccctgcctcccaggttccagtgattctcctgcctcagcctcctgggtagctgggattacaggcgcgtgccaccatgcctgagtaatttttgtatttttagtagagacgggattttgccatgttggccaggatggtctcaaacttctgacctcaggtgatccgcccacctccgcctcccaaagtgctaggattacaggcatgagccactgcgcccgactagtaaaatatttttgagtagatggctaaacagcagaaagccctgggaggcaggacggcccagagaaaggatattggttgagctgagtgtcaggcctggggctcggtgttggtgtggatctgggatccagataccaatgactagctgggtgatatcggacatttcctataggtaggactagtattttggtagggttcttttcatttgtaaataacgtcaagaactcaaaataccaagcgtagggcttgatgctccatggatcctccataaagcaagactctttgcttagcttttcattatttcattcatttcagcatttatgtcagtgtgtaaaggatacagcaacctgttgacttagccagcacattttctcagcttagatactggtagttaacagtattatttatctcgtcttgcatgatgtacctctaagaggtttgttcatcaccaccatttcaccacagcccttctccctgttagcttagctggggtttccaaacgtcaatataacagattaaatttctttgttaaatatgaaggtgagtgagctgaagtatgacttgtcccaaaatgtaacaccttatgagacaggcctagaacctaggtcttccataccctttcatgctgcctgagtatctcagtgtggttggcagcctattaaaacacagacataactgattcaactcagggtcacaaatgtacatatcagggaactttgttttatttcgtttggtcatatggatgctgagagaaggtagtgtaaggaccactgcttaccgttctcagctgttctcttcctaagcgcaagtagtgggaccctcacagccctggatgcattgttgtttttttttatctcgaagtaaatgactgaagaatcagcaggagttttccagaatgaaaatgtaataccttggtctgtttggaactcagtcaacaccttaggaatgttctgccaagcttgtttatgttacaaattaaatgtatgtatctttaatatttttgttgttggtattctctcaaaacaagaagataaatgacatttttaatgttttttttgagacagggtcacactgtgttgcccaagctgaagtgccatggtgcaatctcggctcccaggctcaggtgatcctcacgcctcagcctccagagtagctgggacctcgggcgcacaccaccacacccagttaattttttgtatttttggtagagatggggtttcaccatgttgctcaggctggtctcgaactcctgagcttaagtggtttgcccatcttggtctcccaaaggctgggattacaggcatgagccaccgtgcccggccttgttttaccctattttgattcttccatggcttttggaaaatgcactagatttttaattctttgggccactctcagataaaatatcgctgtgtactactattgacatgttaatttgtcttctaacggacaattatatatcccaaagtcatgcctacctaatggtactttaaaaggactaatttgatgatcactgttgaggatgtagaaaggctgtgaccctggcctttcaaacacattctattcaattttgcaaattgagaaggaaagtaagaggagaaagaaaaaaactgctgtaataaaattggaaattgtttcaggaaattgcacgtgctattgagatctttctctgataatttagaaaaggaaatacaaattctattatatattttatattgtacatatatatatttttttttttactggtttattttcagttgaagattaattacatccaggattgtaaattgctcacgggtcattaccagtcacctactgtcttgcagcagagcaggaaatcagatgtgggcgctttaagatgagctggtttagcgttcacttacttaaagatcagtaccaagccgaacccccttgggaggagtcgatggctcatttggccccatggggagggcggtaattaaactctgaaggcagccctgatgttcagctaaaagctggtctttaaatagtaatacactcgccttgtaaagtgctaggccctcgggtggctgttgacacagtgcgaggagctggcgcttttttctataaaagccaaattgaagaaactgttatgaactcatctgcataaagcaatatgattttgcctgagggtgcaggcaatggggagtgattaaccaaccggctctctccccgctcctccgcagctctgctaacatgccacttgtcactaaaaaattggagacaccatatgccaggctgcctctgctgagcgccccttactgatgccacgcgaggaatccctccccaatttggggggctgcgggacactgcgcagtgtctgtctgtagaggaaatgctgcctgcctgccttcgtcttgctccctgcctttctcagcaaggacattccattgttccagggaacgtggcagagacgttctgagtttgcttgaacaatttgaggcacatttgaaggacagtggaagcattgctccagaaacccagtgtccagacatcttgtttcctctcctccctgtgctgaaggctggaagaggtcccctgtggctggttctcatgacctgccttttgattccaccggtgtctttgtacttgtgcaggaaactcaggagggcatgccttcctcctgcaagccttttatttctcctaaaacctactttgcgttctgtctcccgatttttctgtgctccattaattatgcaaacctcttttgattcaatgtgcaaacagtgcattaaggttttaaccttgaggagaatggttttcatgaggcctgacagctgaatcccaggacttggaaaaggagacgactgtgtttggcttttgaagaattagctttcacgtccctccgggtgataggtttgggtgcagagtggcttctgggctgatttgattataagccaccattttgtgtttccctcagtcaccagaattaagatctttctaacagcaggcgtgtaagaagcaagaaaggaaggccgtggtgtgggagtgtggagaaaaatggattctagaaaggttagcaggctgtcttccttgctgctattgtgtctacaccgggggacagtggggtcatgtctgcctctgggctgtcttccccaggatagacagggttggggacagagaggacggtgaggattccccatgaccaaggttgggctgctcttggctctgtcttagttgctctgcttgatgttatgaggggatttggatggggttgacatgggcctcaagaagaaatgcttctcagcccccttgcccccaataactggggggtatcagcctttagaaaggatcctccaggctcccaccccagccccagcccctggagcaaaaccacattctcactaggcctctcctgaaaaggggaagtgtaagacgtgacttcccttagaaagacctgagcttctctttttctatgggttttggggtgaggccagcagtgacttaatcccaataaatattaaatgagacataaatccaactttagcaaatgtcacccacagatttttgctaaatcaaacttatttgtattttatttttttaaatggatgaacttcatctcgaaggaatataaaaaaactgacaaaccaaaggccactgaggtccatgcatggactagggaggaaaaccccatgtatttactgccagatccatgccaggagctgtgcttgggcgaagccatagctggtggcataggtattgtcaccccctactcctcacatggaaactgaggtggctcagagaagtctacatgatttgcctaaggtcaaaaggcagggaagtggctgttatttgaatccagatctgtcagacccaaagcccatgatctgttggccactttgccgtttgctttgggccagagtctgcctgaggccctggcagagatgtcactgactgggcggtggcccttttccagatacatatccccatgacccaaggaaatgctgctcacagctaccctgagtgtgtggacccccagctctcctgcacagcttcctactgaaaatatctccccatagatgccttgtgaatcattttcccaagaaaaggacttctctacaccttaaccctctttaaaaatgcttgtgtcctaggaggggagaatgtacccgctgagtttcatgcaggggtcttgtcagggaagacagaatgagtgcctatgcactgccaggtcctggtaccagatcacatcatttaagtattacgaccaggttactagggattatttggatcttcttttgtggaggagggaacaaaggctcgccaaggctggaaacccaccaaggtttcccactggtagagaaagcccagactggacctgactttctgttcccaaagcccttgacacgtggccactccagtcactggttttctcagtgacagactggctgggctacacacaagggggctaggggctgaagccactttttgaggtgactctttgttctcccctcattcagtaagtgttggaggctggtgctcggagccatagccagaccattgctggtgccagctcaatgcctgcagtgtgctgggatggtgtgcatatttcacacatcatctcacacaattcttacccctgccaagtgtcccaggacacctgttttagagatgaggaaactgaggttcccagaaagtcagtggcaggtgcaaaggtcatgcctctttgtgtgacttctctgtggtctgtctggtttcccatgacatttctggcttttataaactattaaagcacagactgaaagaaaaagtgggactttgcaggtgaggctgtttaacgtgctggaagagtgaatatatgtaaaatttcggatattacagggctgcctatccccagtggaggttgtctgggcagaaatgatttccctgatttgtgaagattaataaatattttgtaggtccttggtcaactcaggctgctgtcacagaataccatcgtctgggtggcttaaacaacagacattgatttctcaattttaggggctggacatccacaatcaaagcaccagtagatgctgtgtctgctgatgtccatgtggctttcagatggtggccttcttactgtgtccttgtatccctacatggcacagagcagaaggacagaacacaagctctcatgtcttttcataagggcactaatctcattcttgagggcttcatcctcatgacctaatcacctctcaaaagtcctacctcctaataccctcacctactggggtttataatttcgacaaatgaattttggagaaacataaacaataggttcctaaattttgaattctggcgcctattctacctttttttttttttggaaacttttaattaaataaaagtgaatacatgacccagttttcttatttggaaaaaagtgacgcaagttcaatttgactatcaaatgcaaattgaaagataattttcatttggaaaggttcaattgataaatatataacaacaataaaaatggctaaagtacatttcctagggttgtcataacacattaacataaactgtgtggcttaaaaaaattattctcacagttccagaggtgggaagttcaaaatcaaggtgtcagcagggtcgagctctttctgaaagctctagaggaggattatttttgcctcttccagtttctggtggccccaggcattcttcagcattccttggcttgtggccgtatcacttgaatctgtgccttcatcttcgcagggggttcttctctatgtctctgtgtggcctctcctcttcttacgaagacactaattattgggtttagggctcaccctaaattcaggatgatttcatctgaaggtccttaactaattacatctgcaaataccctattttcaaataaggtcacattctgaggttccagaggactttcttaattttggggtgacaccgctcaacttagtacagctgctattcatgtgaagtttccgatgtgacagactcttccaagtgatttgcatatactttgcatagactgcctcccataattcctgttctactccgtgaccaaggcttattcctcaatttctagaaccctgcatggtgagttattttcagcccacctgcctgtattatgaagcttctcccctgccctcctgactcctgctgatgctgcaggaaatttcaccagtgcgatggctcacccctcacttccaggtatcctcttggttaaacccaactcacactgactaagagttcaacttggcacttactgtctatggaacaggcattttcaaagttaaaaagttagcttttgaaagaacagtgaaagaagtgttccccttgggtaggtagatgagacaaataatgaacacaaccgagagcagcaatattttatttacaaatatttttaattatgtaaatttatatgaaataaaacttttaaacaggagattatgaataataatagttgtcatttaatactttcgttgcctggggacagtcctaaaattactaaagtaatgcttggcggctaggtgaccagagactcatgagaagtactaatttgatatccctttagaggtaaaggtggaagactgataccaagtagacagggtttggaggcttcctcaagctgggacttagtttcccttgtagatttgggatccctgcccccccattcctttcctccacagactcactgtggctcccccttcccatgaggtatgaataaaggtgtgaagaagggatgtgtgatttccattcaacctgacattctgcttaatgcattcccctagagggtcgcttgtgataggacatgacctaccccagattctggttctgggtcatgaggccaatgctctgtgacctggctgcccatgtcctcttcatcacttagctaaaggccacctggatgccaaatggtggatcccagtggccatcataacatttcttgtccccatccctataattgattgctggaatcagggaaatggcaggacttcctaggactaaaatgtttaggcctttggggtgttggaggtgaatacatcaggttttaaaaatttatggcatttagacacacactgtcagagggaagaggaatcttacttgtctgacctttccagcctatcaaatattttaaatacttaaacatattttgtatgtgagatgtattctgtattcttttttgaaatgagccagatacattttatttaatgcattgattgtttccccttaaaaatgaatcagataaatatctcaaggagcatatattgtcttcagggaaatgccacacagtgtgatcagcaccaccgcagaggcccgggtgaggggccagtattcagaagaggacacctacctggagctctttcctggggtcgtttctaatattgtgacatgatgctggactaggaagacctggagtctggttaatggtgcaaatatttaataactaggattttaagcactttgctccaagccttcatttccttattgacaaaatgagcaccttagcccattttgggttgcaatcataaagttcaaaagactgggtggcttagaaacagcagacaattattcctcactgttttgggggctggaagtctgagatcaggttgtcagcagatctgtcatctggggaagccttgcttcctgcttcccagacagtgccttctctttgactcctcagatggcagagagcagagctgaagaataagctaactcttgcgtcttttctaagggcactaatccaattcttgagggtcccaccctcacgacctcactaccttccaaaggccccacctcctaatacaatcacagtgggagttaggatttcaacatatgaatttttggggagcacaaactttcagtccatagcaatgagcaattagaacaatttgaaaaccattaatctaacttccacaacatttgagagtagatgctgggcatccaaatgtgtttcttgtgacatcgttacccctaaaaatgttctcttattacagtttcaaattcatgttgaataggtcattcccaacgatatgtatagatagcactgaacattcattttttgagattgagtatttattttttgaaacattctatatattttgaataatcttcttctgaaatcagtcagttagagaacatgtaggcagatagtctcaatgaagaagtggatcaaaaatgccatgtgttttcagaaaacaagtttcttttgttaaaactttgagttcctatttctttttctccatgctcttttgtgtattttgcttggttctttctttgctttcagccactgatctatgcaagtgacattctttttgatcatcaggactgcaagttatcccaaaataatgccttttgttttagaggcgttgccacatctaccaggtccaaaacaaatagaaatttaaatttattccaaatacttgtcttctactactttcagtgcaatacattttgctgaatttggttggatttcttccaagtcttcctaaacatcaatatactgaaaaatcattcttccttaagtataatattattactttattaaagttcattttaatacatgtaatgacatcacaacttgtaaaatgttgaccttaggtcttatatatacttacgcacttatatgcatttatgtgtgtgtatagaccacacacacacacaaatatacacatatatgtgatatattaaacattttaaaattcttgactctgagaaaggcctctattcttttaataaggaaataactttcaatttatgaagtaaactaaaccagaataaatggtacagacaactatttatgaagagcattatgtttaggattcttctcttaaaatacttaaatttaagctttgctgtttattctcgtgtgtttcaaatatgtattatctgatgcttactagcacgcactttattttatttgtaaacttactttccacataggtcttgtttcagagaagcatttaaatatagtctgttactaaaggctggcataaaataagtattgaaatagaggcaattgcagaaagttctggactagttatagtaatgtgaatgcttttttattgaaaatttttatgttatctaatatgcagaaaacaaatgaacaaaaataaaaataacaatggcctgtaaaatgacattcattagtattttgatgtataaaaagacttcccctgtatcaagattatattgatatgcaactggattttcttctaacacttttattgttttatttataacatttagttttgtaatatgcacctgtagtcccagctactcagaaggatgaaagcagggtaatcacttgagctcattaactttgagacatgcctgggccacacagcgaaaccccatctttaaaaaaaaaataccccaaacaaaaaacctttaaaagtaatatatatgggattccttttaataaaatattttctctcagttgttagttggttggctcaatatttgttggtggagtaatggcattaaaaacggattgaagttgatcgaagagggatcagggttgcacagaaaggctgggagggatgggggagctcttttagggcattttggcagaaagcaaaggagatgcgggacccagtagcctaagcagcaccccctctcttttgttcatgtttgtttattaccgatctttttctgatttatatttttaaagctcttatatcctaggaagttttgtttgttgcctccttcactaagcttcctacaatgtggaagaattaaggccatatttagtgacattagaacacaggaagcaaataaaacctgcttctcatcctccagagattcacagcgcagtgtgaggaggggcatggagggacgtagatgtgggtaattaacatcgacagagagattacgctgtgtgtgaaaatagaatctctgagtcctgtgggagcggaggggagagaggaattggttctatctgggaaatcaatggaggcttcttagaggaattgttgtttgatctgaacttttgccttcagaatctagacggaccttaattaatgtttagtgaatggattaatgaatagagtgtttttttgctttctgcttttgggttgtgtgtgcgaaggggaggtgagcgggcatcaaatgtaggaggaacggcccagaagcatgacagttgataattagtcattgtgtgttaagagctcattaattctaataaagatattggagatggatcatacgtgaaaataaagcaccccaaatgcataatgcaactcaatagaaacaaactgctaaaggctatcgacactaacattatagtactatgcaagtaaggacaggttttttggccatatttttccatagcatctaggaaaaaatagaaacgtgaaaatatttgtgagtacatgggaaaatgattttatgttaataaagccattaggtaaaacgagacacaccaggaatgccctgggtcttatctgcatatagagactatgctttcatcttaatgaaggtatctggtccatattttcccttttcaaaaatctcaggaattgtctttttttcaattaataacatcataatatcccttctcatcttataagaaacagagatacacaggaccaacaacaaaaaacatccttgctcttgatctgtccctgattataagtgattttagctgtatttcatttcactgattctgtttgcaaacaggctttcacacttgtttttaagaaataaactccttttctcaaataaaatttcactggaaatcccaatttttcttttttttttctttttcttttttttgagatggagtctcgctctgtcgcccaggctggagtgcagtgacacaatctggggtcactgcaagctctgcctcccgggttcacgccattctcctgcctcagcctctccgagtagctgggactacaggcgcctgccaccatgcccggctaattttttgtatttttagtagagacgacggcgttgcaccatggtctcaatctcctgacctcgtgatccgcccgcctcagcctcccaaagtgctgggattaccagcgtgagccaccgcgcccagccatggaaatcccaatttttctaacaaatctcagcgatgctctggtggacccggtgtggacatctggggtctgggccctctcggcctccccaaccacaagcttgtcccatggagacccctaaagcttgtctgtaaaacatgggactcccttaagtaatcactgggctgtggtcagcgaggttccatcctagtcccaagttttgttctatgaaagtctctgtctgggtttcttttcatcctctaaaggacacgtttttctcttcattttacgagttgattttcctttgtgctgtttcatcctctactacttgacctcatgaaggaaagacggaacccagagaactaggtattgcccttcattgtgtctgagaccccgaataataaattagagcagaaatgtatcattgtctttcttctctcctccttcccctcccttgtgctccatgttccccagtctcatcaagcaattctacctgagaggccttaagatctgatttgaacaccacggccttgatgactttattagcaggcggttcaaggaccacactgggaggaaagaaaaacaaaacacaacagaaaattaaaataaagtaaaataataccattgctccagaattcattgtatggcaaacacagaaagcacaatatcaaggcaaattttgatttcatacttaaaagttgctcgcttttagttttgggccaaattctgcttggtgtcaaaatggggaaaccagaattgttttcaaaagatgaaatatttcccaataataatttaaaacttggacatttcacagctttgtgattgttagaggaaagtacttgggggagtggcgcattttggttgaagccaacagctccgggtcctacaggacagcgtgatgggcctgcttagcttcctgctgtgcttggcgtgctgctgtgcacggggttagctttggattcatacagatgctgtcatctctttcaactggaaatgaaggagcactaacaccccatctcttgatcaaacacgtgacctctgagtggagagggcagaagggctctcaggagtgagtgaccgatgggagagaggctatccccaaattatttggctgtcaagcagacctttacccaactgagtggcccctgctctgcctctgtgtcagacaaacactacatccatccctttactcattctcttgctccactgctcactcactcacctaccacttagcatttattgagcgctctctctgagatccagagatgaattccacctgggtcccacttcagggccctccaaaaccacatggaaggaggaggactacttcatataatgcgaaaggtgcttgggaagcgttggtttgttggggctgctgtaaggaagtacagccagtgacagaaatgtattgtcttacagctctggaggctgcaattctgagatcaaggagtcagcagggctggttccctctgaggctgagagagagtcaattccaggtctctcccagcttctgggagtctttggtgtttggtgatttcatctctgccttcatcatctcagggcattctctctgtgtgtctgtctgtgtccaaatttctcctatttataaagacaccaggcatataggattaaggacccgtcctactctactataattttgttttgtttaattacatctgtgacaaccctatttccaaataaggacagaggtactagggattagtacttaagcatgtgagttttttggtgggggtggggaatataattcctataaaaggtagcattctctcccagtaatttcttcttgaggcattagatgtcacaaataaacaatgttagttttctcagagtttagttactcaagagtgctgtccatttgtggacatgtttgcaagaggagaaggcagcaccgatctatgtcataaatcagcctgctgtctgtctgtctctctctcgacctacctcccttcctcaccacatattgaataaattatactgagtgatatgatatttcagtaggcctccaggaactttgttcagtgaaaagagggtttgataagttgttaaacaataaattaatcaaagtgctcaatgctaagggactttcatgggtatctctgtggcccatgagaatgttctggaaagccagggagagaaaaagatgtttctcaagtcatgagctggagtctgagacctgaaatgggagtagaaaatcctctgccttttcatccggaaagtttggaataagttaggtgttttgcagttctaggagcatttattaaggggcatttcctaagtgaggcagtcctgttctggggatgcacaaggaggcaccatgcctctggccttcaaagctgtcacggctggacttgtttttaaaattcgagagctttaaatcaagttcagaaatcattgccaaaattttctgtgtcctctttacgcatcccaaaactgtatttctgtgtcagccgttatattatgtccttacaaaaattaataagaccaaatcttcaccctgaattagattagaatctaccgggaccgggtgcagtggctcacgcctgtaatccctgcactttgggaggccaaggcgggcggatcacgaggtcaggagatcgagaccatcctggctaacatggtgaaaccctgtctctactaaaaataaaaaaataaaaattagccaggcgtggtggtgggcgcctgtagtcccagctactagggaggctgaggcaggagaatggcgtgaacccgggaggcggagcttgcagtgagccgagatggcgccactgcactccagcctgggggacacagcgagactccgtctcaaaaaaaaaaaaaaaaaaagactctaccggtcagctttggttttcaaaatccattggtagagtattggaaaacctttgaatcttagatggtttcacatcacctctgtaatgacctgacctctaaatataaggtcatattctgaggttcttggggttaggacttcaacataggaatttagggggtcacaactcaacccttaacagtgtcccagtcggcatcacaggaaatcagtttccgcttcttctccaaccataaaatcgaacatgctgatgcccactttcattgtttttcgcacatttgctggctgaatgttggacacttacgtttattaaaggcatgaggttcaccattcagagatgtgatgtaaagtaacgtctcaggctcaacactgcactgcagtgggtgtccttgtaggggcttctttatttgccttgagaattggccacagcacttacctccagcttcttgcctataaatacttctcaaccaagtaggtgtttttttctcccaaatcatgatccatgttgaccttgcaaggagacaaagtcctgctttaaatactttcaggtgtggttggacctagacatctctcactatctttgaaccagttggtcaccttgctccatttaggtgtatctgaggtgccgcgtctctctacagtctcacaaccaccaacctttagcatgttatgtatttatctgcctgtcattcccacctgactttgagcttctcaagggcaaggattggctcttatccatcctgtctcctctgcacgtagcacagtgcttgctacatatctgatactcaactaataatgtacattaagaaatgagatgaatatatttttgaaaaatgtgcttgcatatctacagttagttgagtctctacagtaggaatgatgctgataatttattttttaacttcgacaaacactgtgactcttacatcctgattggtaaaggctgaatgaaagttaaggaaactaaggcttattgagatacaatgtggcaggcatttgccaggatctgaacacacgccatcacatttaaaccacaccctaactctgtttgcatttttgtctgacattatggttgaggatataagtctagggaaattatttgctcaagttattatatgttataataaggagaaaatgaacattttgtttttagtgcttattcacatgaagcactgttctaagactttaaatatgtattatcttatttaattctcccctacacctttaagatagagagtgtcattgtatccattttaagaatgaggatacttagacacagggaatgtaagtaaatatgcagatcagatagggagcaggtggccagccagcatgaaaacctagtgacttggtatcaaaggttacagtcttaactgtgaccacctcttggggaaccaagtcagacccaggtatgtctatcagaaaagtccatcctcttgccccaagctggaaccccctatttttcttattcactactagatgataccacgtaagtttagagattacagaggtaatattgggagaaatcattacaaccgcccatgatttgatgtcattctgtactttatttctaaatcagaggataattgataatagattaaattaaaataagtaatatagaagattattttggggtaattaccttacataaaattattgagtaacataatagattactttttaaaaatatatcactctatatcattgccctggatagcaagcaagatacctgctcttcaaatgtaaagaatgtttttcaaggcagagctcaagaaatatgttcataaaaatgaacacttggtgataaatgtcatcatcctgcagagtgaagcaagagttctggggacatgcctgtggagtctccaggtccacatcaaggcggggtacacacatggatcaccccaagtctaccctttgtgcaggaagactcccttcagctaccctggagatgtgcacattttctagtcgaatttcctatttttccctttcttacatacaagaggaagtaaaaccttgacttgcttctgaactgtcacaaatgacatttacttttttccctgtggaaactacttgaaataattaatatccaagaatataatctttatgcaactactttactcctagagaaattccaaggttagaaaatgtcaaaaggaatctgaattgattttgccacctggggtcaaattttctattctagttatgaaagtcaattttcataaaaaaatttcacatactctaacctgggaatatcctaatttcaatgaataaaaaacatatggctgcctgtttaaattttgacttttaatgcagaatggtggtatttagcttttaccttctattttataaaattctgttattccataggaataaagtagatgcagatttatcaagtaaattttaaaatatgtggccattttaaaatgagatcatacttgcagcacatcaggtattagtaacagaagatttatttaaaagaaaatcaaatggatttcctttcagggaaaccacttgaagaagctagaatattgagagtgatgacatgttccaatcacctaaataggttttgaagcttcattttcaaacctagatggaggaaggaagagatagaaaaacagagggttagatggaaggatggatggatggatggatgggtggatggatggatagatgggtgggtgggtgggtggatggatggatggatgaatggatggatggatggatggacagatggatgaatggatggatggatggatggacagatggatggagggttggatggatggatggatggatggacagacaggtggatggatggttggatggatggatggatggatggatgaatggatggatgaatggatggatggatggacagatggatggatggatggctggttggatggatggatggatggatggacggacggatggatggacgatgggtggatggatggatagatgtttggatggggaaatagataggtggattcatttcctttaacaatgcttatatgttggttttgtgcatcagatcttgaattaggaaatcagagaaagaaacaattttcacatatatcctggaatatgcaaaatattttgtacatatatagagcaatgaaaaggaaattattcttacatgcattcacacatgcctggattcatcacacacattggcaggaggtaaggatagttttgattatttttaagccaagacaatgaggtagcgtttattctctttacagtatcctgaaacaatcttaggacctacagaatcccttttcactcagattccctgcttttgctgactaactgcaagtgaaacatttttccattgaacttgtaaagttaattcaattaagtgactttattttaacccacgtctgtccaggcttcggatgactgtgccatccctcactgaggctgtcacggtggtccctggggccctgtgaaatgcccaaaagcacatatgcgcacatgcgcgtgcgtgtgcacacacacacacacacacacacacacacacacacacacacagagccttgtggctgttttgaagcaccacccccgccaaagtcctacccagggccattccatttgcaggtttctctaaccccaagttctctcttctccaggtcaccccatgctctctctcccccaggttaccccaggctctcttgctctttcctttgagtctctgtacttatgtcccctcatcaggatgcccttggccatcttatatcagcagcatgcccccatcacccatgatcttctttccctgcttgctttcttgttccggaccactgagctaaagccctcggcaagaactgtctgaacactacatataaatcatgacctgcatgagacatttctgaccacctttcctttatgtttccctatagctttcattaccgctgcacataccccatgcttgcttatttatgtgttgttttttgcttgccttccatgtgtctagaacattcatgttgtctgctcattcagtgaggcatctcagacacctagacttgaagtgattctgtcacaaaatagttcagggaaatcaatctgcaaggaggaaaaagatggatcttttatttatttttttaacttgacgtcagcaactgtcttatctgatatttattagtatttcagattcattgttctttttttgttttccccagtggtttgaattttaaaggaatttctttgtataaagtattttaagcaccctcttttatataaagtattaaatcataacattgatttaaagccatttaatttgtatgaccttttaagcagccgtgagagcataaaagaagagtgtatcaaagcaaaaagtaagaactcttgagtcttttgaaaatatttactttgaacagattgcagctccttaaatgatgaggctttggaatctgggaggtggtcagaccccagctctgcctacttgaggccacccacatgtcgctggacccactgtgtgtcctccccaagcccagcacctcatcttcaaagtgacacccacaatagacagctgtgcagagcattgagtgggatgctggatgcagaacctgccaaatatcactggttgctgatttatcagtttaattgaatttctgctgcaaaagaaggaaaggaatgggggcaagacctgcattttccatgacaagatttgtgttttgatggcagggaatgtgctgcatgccacccacctgtgatgcaaccactcaggaatggggaccaaacctttttgcccatctctcctccttccttaaggctgagctgagagctctgggttggaatttcctgttggaatctgctctgttcttccttcacccttgccctgagcaagctcactgagcagctgcctctctgagccgggagctgggcccagtggtggaaatactgacgtggtccctgcccatcagtctgcagtgcagaggggaaacacacccaaggctactgtgggaccctggggtgtgctgggtgctggagaaggaccgtgcaggagcttgggcatgtggctataagaaaggacaggtaaacggagacaggggtgaatgaagaatgagacaggtgtggtggctggaacggtgtacccagcagagggaacctgatcccagagggtgcataatgcgcctgagaccggcagcagccttggggagagggaggcagattccaggcaaaaggcaagctgcaggtgccagcaggaactgtaaaccaccatgtcctgcaagccttggtggttttggctctgctggtgttgacgagacgccaagaaggagattgtagctggagagagacaatcacgttttcagtgtaaactcttattctgcctgaggtgtggaaaatagtcgtgggaacgaggctgaccaacaccagaagcagggcactccttgtacatagttcagtcgaggggagtctagggaagcctgaatggatggttggatggatggatggatggatggatggatggatggatggatggttgaatggatggatggatggatggatggatggatggatggacaggcagggctgagagatgttatggcaaagaggcatgtagctttgatggacaccacggatgtggacagagtgaagaaaacagggaggatgttgtgactcccttatcgagcgatggggtgggtggtggaaactgtggctctaggaggggcctgaggaaatgtgggtttagggtggagaaagggtggtttggtattccataggtggattctgaagtgtcctgggatttccaagtgagaggaaaactgtctctatagatgagaaaaaatattttcttagagcattttaatgtcaaatagaacttattttaggttatttgtcattttaaattagccaagcacttgagtctttctatagggtggatatgcaattgctcagaattgtcttatcatgacacagaatgggatagagcatttactttcagtgtaaactcagttcaagacaccacctgttatcagagctcccaaaagacaacttgtagacaaccagtcaactgaagggctgaaaattattttttgtgaatatttaaaaactttttttaacctgtagttttgtttatcaacaaaagtcaaattgagaaaagagagcttatcaaatctgtatgtgacttaaacaataaatggagtttcagttcctgggtaagaaaattattctaaaaagaaaaccaaatcaggaggagtcaatggtgtttctttgtactgagtttgtgtctgtcgtacaatgaccatggaatggtgcacttggtttggacaagtcacttctgggggcagtgtggagctacagcagagagcaactgagatgtgagcccagggcaattgtataaggtgttcagttcttattatttcatcatgttaaggcatctcttgaaataaacagcacccttagagttaaagcaatatatctgtgacatagaaattgtttctccaaagtattgctggggtcaatgggaaataagcaacgacaagcctgttcccataaactttattgcctcctgtaactgactttctaagtaaataaaggttcttagttttgcttttcttgcagaaaggaaagaaagagggatacccgagggatagatagccaagagttatgctaattctctgatattttataataaaagagatttcatctaaaaagaaaaggaggttctgaaggtggttatgtacattcttccaaactcaaagtcacgtctggaacattcttatatggaaagagctaaaaatacttaaaaatttaccttgaacatttctcatccaatcatattatggtccaggcaggtgctgatatgagggacatgatggtgcaatatcctttgacaagcagaagggactgtgagtctctgaggatgggatgcagacctttgatctgctccataccaactatgaaggaggtccatgtgcttttgaaacacattgtaaggatccaagactttgcagttaaggttgctcctaataaacacaagctaatagtgcaaatatgattcctgtgcaaaggtaaaactatttaacggccactaagaaacagcaccctgttttgtaatagtaacatgtaaaaccaatggcagatgcatgccagcgcctcttagcactggagagcacagtgatcactgccttactggagaaacttcccagaggggagtgccatggaatgctttgaggaagaggaggggctaaaaatggaaagcctaggccagaagcagtggcttatgtctgtaattttgggaggctgaggagggcggatcacgaggtcaggagatcgagaccatcctggctaatacagtgaaatcccatctctactaaaaatacaaaaaaattagccgggggtggtggcacgcgcctgtagtcccagctactcaggaggctgaggcaggagaattgattgaacccaggaggcagaggttgcagtgagccgagattgcaccactgcactccagcctgggcgacagagtgagactccatctcaaaaaaaaaaaaaaaaaaaaaaagtggaaagcctggacattgccaaagacaaaatgtgtctttcatcctgtccatgaggaggctctgactgctgctcacctcgctggctgctgctctgtcttttatcctctaggattctgaaagcagagacaatgacttagcaggtgagttactgaggccaactgagcaaaaacaaaggacagatggagtacctggcagtggaggagtagggacgtataaagccatccctcaaggcttgtgaccttaaggaatagaccagttagttagaaagacaagatgcacttgtacaaaatttaccaacagtatgagactatggtgctagcaaatgtcacagacatgacgattgaagtagaagaaattcttggctcaaggaagagcaatatccagtatttactggaaggaatattttaaattagtgctgttctagaaaattcagggcaatggctatgcattattctatttataaaacatttctacacactctatgtataataatgtataacaaaataacaggccagtaattactataatggagtataatatagtatattatgagaactggaggccaagttctcagaggaagccactttattccttaagttaatatgatgaatctcgctttgtgtctcttatgccttatttgagccacacagaggaggaaagaggagaatcccaacacatagtagattcttgaatttcaccattaaatatgggtcaggactgtggctatggctgtgcttatgtcatggagagctttgtgaaattaaatcaatgatgatttatgaagtcatcatcagaacatggtagaaatactatggttttgggcactgaaccaccccagtgttgaaaggtttgctttttggctttgaggtttaaaaaggagctgtgatattttgagacacagagatgatggatggcagccagaccaggttaccttacatggcagaactcctggagatgactagtggcatgattagagcatccgctcctgtttccacagctatgaggcgggtggtcttcagataaaaggagagccgcatacagggtttctgtctcaggatttcacccacggttcttcctccagaggcaagggtgagcttcatgtttcctttgcaccagtagcaatgacagcagaaacaggcactgcaatataattatactggatttattccagggtgtatctgttatttattactgtataacaaactacttcaaaacttagtggcttagaacaatggctatttgtctagttcatgattgtgtgaactggcaatttaggctgagctcagttgggtggttcttctgctgtcagctaggttcagtcatgagtttatgagcagctgcctgtcagagaggtggctcttctcctggggttggttgccagctatgtgttaggaagataaggagaactggatcattgtttcctgttgtccagcaggcaaccctagactacctcacatggtagctcagtaggtttcagagagagagtgtgcagaagcttagactcagtgctggtacacagcaacttctttcacattctgtgggccaatgtgaaatacaaagatgccccatgtggctagagtggagaagaagactatgggacttgataggaggagttgtgaagatcattgtaaaggctatgatacttggagacatggaggattatggctatttttggcatctaccatacatggggtagattttgtctgaaggcagtgtggctggaagcatttaggaagtgagagcttcacctgtatgtccatatagggacactatcaggaataggaaggtcagagaaaaatggagcttaacagagcaaatgccctaaagagacacagaggccagagccacctgcttggaaagatcagagggatggaacagcagggcagggactttaagccacaccaggcagtgcaaatgctgctaactttgcaggggctcaggaacacaggccagggaagcaccttgacctcctggctccaaagctctgagcatcattcttagaaatagctcccctgccagcatattttgtaccactgagaaagtgactcaggatcaaatccagagctctgttttttttttcttaattaactaattgattttgacaaataaaagtgctctgtatttaaattatataacacaatgttttgatatatgtatatactgtgaactgagtgccacaatcaagctaactaatgtattcaggcctctgttgaagtgccctaatggttctcttcaaactgctgcaaaaatctgataagcaaagttcctggccagcccgaagttacctcgagggctctcattatctccctgaatcccaccccccggcctcacctaccatgccatctctcaccccatcctcttttggcagatgtccttgtcttctacacacctgaaaaggggaaggcatccagtttcatattctcattgcagcacctgtgtcagttaaggcttggatggagccctctgagtagccttcacccccttctccctgaataagccaaataaaagtgggtttcatttgagggagtgacatgtccctgaaaggcttggccttgtggtaagtcacaaacaaggcatgaacaatattcccaccttctcctctctgctaagtacttgccctgaaaaaaactaagttctgcaaagtgctcagagggtttaggtgtgaaccacccagctggaggcagagttatagctctgcctctgggggccagctccagctgggaggttgatgggagcctctgacgctgggctccccgagaagcaagatcctagacaagaatttgagtgtaaggaacttctttcagaggcaggcccagaaagtatcctaggaaattggggaacggacatgggaaagaaaagaagtcagtagagagggtgttgtccagcagtttattggtgtgggaaactggggttcagtcccacctggggcccccgagagatttggtacagtacacttcaaatgatcatgtctgagataccaggagcccaccttatctatggctgaggtctgttcatgctctgtcttgtttgctggccaagagaaggttctcagatggaaggccacaggggttttcagtaggagccctcttggctgagactgaaatgagggtacctcaaaacattaagtgaattttctgagaccatatagctgggagctgagtctgtctaattttaaagtccttgttctttaacaggagaaaagagaaaatggtgacaaataagtagtttcttggatccaagacattgagagtggctatttcctccttgcacagaaggcttcttgatggaaaccaaattactctgaaaagttactagttttaatatcttagcaaatcatttgatacattcacggaagtgtttatcagcaatgtataattgttcttctcacttaaagaatgtttgtttcatgacattggagatctgtaacacaaagacccactttgtatgatgaacccccgtggtgtagctgcttacagggccctcacacacactcttttggtccctgaccacatctgttttaacctggttctgactataccactgtccactgctagacagaaaagaggaagacatgcctcattctccaaaaactggaggaatggcatcattttcaagtttagtttttgttgtttccaagtatatttatgtaatgctgtattatatgtatatacttgccatgaattaaatacgtcacaaataaaatccacttttgggactcaacagtatgtaaaaacacaagtagtatgaacagatttatttataaagttatgatgagcctttctgaaatctttctagcatatcactggtgtaaatgtcatgggaattgaaaataatgtatttgaatttcacagtcttctgtgaatggattttttttttttttttttttttgagactgagtctcactctgttgcccaggctggaatgcagtggcatgaccttggctcactgcaacctccacctcccgggttcaagcaattctcctgcctcagtctcctgagtagctgggattataggtgcatgccaccacgcctggctaatttttgtattttttagtagagacagggtttcaccatgttggtcaggcttgtcttgaactcctgacctcatgatccgcccacctcgtcctcccaaaatgctgggattacagctatgagccaccacacctggccctgtgaattttttaatactgcatttcccaaaaagaatttgtctttctctactttttaaaaaaagttttccctgagtctattataaagtcattcttgaccagaaaactcaagcaaaaaaagaatgaattagttgacttgtccagattctatgtttagcagacatgtgtaccaagagtttgtattgattgttaatacatgataacacagaaagcgctgaaaaatcttaactctatgtaaagtgtttatatatgtatataagcacttaagattttatgtaatataactttttctattcaaccttttaaggaatatctaatattttaaattactttatcaagcaaagaaaaaggacaagtttaaaaataaaaacatagaaaaggaaaaaaaagagaattatcctgtggtgttctctcattaacgaaaaataaaggtttcggaaaatctgttaattttccaaattttagatttttatgtgctattagattggaaaatgacagattaaaattttgaaaaatttgttcatgaaaattctaactttaagttgctcatgatctaaattttcttagctctcatgagatctggttgtttaaaataaataaataaataaattttcttaaggacccaactgccactaagattgtttaaatggtagctactggcattttttgttataagccgaatttctttcatcaaatcaagctcacacattcactcaagttcttaagatactgttgaaatgggaaaagtccctttgtccccctctcagggtgtgtgatgggggtgtggctcgtgttttcggtgcctcactgctcaaactttcaggagagggcatacagacaggcaggctgtggtgactccgaccccatggcagcgtctagaggtgaatgtttacagctcctgaggccccagtgtgtgtgtgtgtgtgtgtttgtgtgttactgtgtgctctattggtttagcatgtgcaggtggcttgtgcgtatcagatcaattagactcctgccttatcacaaagacagagggcttttctgtatcccaggatttcttgctttgctgtaccagaagaatcagatcacacctgggcttggagaatgagtgcaaggttttgttgagtggaagaagctctcagcagatgggggagccagaagggagatggagtggtaaggtggttttcccctggagttgggccgctcagccaccagggctctcctccctctgcctccccgaaactctgcggcattcaccggtcaatggcctgctggcctgctggcttctgtcggtgtgctcttaggccggtgcattcctcccgaagtccagccacttgtgtctttttccactgatgtgttcctctcaacatccagctgcttgtgtgcgtgcccgctagagtctcggggtttttataggcacaggatgggggcatggcaggccagggtggtcttgggaattgcaatatttgggcacaaaaacagaaatgtctgccttcacctaggtccgtgggcacaggcctgggagtagagccctagtcagggaccacaacctcctctacccaacacttccctgcccgcttctgtatcactattccttcattaattagaaagtatgcattttttaaaattatgaagtgtctaggtgtctgccagcattactcaataggaaactccaatagaggagtaaagttatttctccaaggtcaacaaaattaataaatacaaagccttcatcaccagagccgtggtgaagagctctttgcactatgtgtaagcgaaacatgaaatcaacaatttatttaccttcagtgtaaattgttcattgaatgtcattatgttgtcgattattgattcctaccgcatgtgacaattacatgtgcttctgccttccctgccctgagtaccaggctgctttcaactctgggcagcaaggtggcaagatagagttgatggagttgcgaatggaaacaggaagatttggcatctgaatctcgaaaactcttgacgaaaattctctttagatacagagatttgataacttcttaaagcgaagtttgttttgctcatgacgatcacacctatcagctgatcaattctgtttccctttcaaggaaaaaaatatgtatcctgcatcagcaaggattcatgaactaaaggactcacagagtagaactctccacttttgaaactgaggagccaaggcccaaagagaaaacgtgacctagatttagtcattatttattgttttaaaggggggacaatcaaattaatgaaggcagttaaaaatacattgcattcttattaaatacattttgtaggatttatgcctgatgatcatgaacatcaaatctgactttcctgttgagcaaaatgaactataatcaagtggaacgaattgctttgctattatcccttgttgtggatttgtgtcagcacatggtaactgagctgaaatgggctttgtttgcttagctcttctcctaaggagaacaacaccatttactctgagtttgtactgggtttctgtctactaactgcttatattggccttactttaataaagatttctatctcactccttaatacggcacatgccaatgggaaacacataccttatgcctagctttgttctatagcagagtttctcaacctcaacccattgacattttgggcaaaataattctttttctcggggagggagtggcgaactgtcctatgcatttttaaatatattttttaaaaagtttaattgacacacaattattgtacctatttatggggcacaacgtaatgttttgaaacgtgtatacgttgtttaatgatcaaatcaggataattagcatatccatcacctcagacatttatcatttctttctggggaacatacaaaatcctctatgacagctattttgagatgtgcgtaccttgttgttgactgtagttgccagactgtgcaacagaacgccagcacttctcctttctcatcgttaactttgtacccattgaccctccactccccatctccctattcctactccttaccccattctattcactatttttataagattgactttagatttcacatatgagtgaaaacgtggtatttgaggggttaatattcagaatacataaggaactcaaacaggtcaacagcaaaaagacagcaaaaaaaattaaaaagaagatatacaaatggacaacaggtatatgaaaacattctcagcatcactaatcatcagataaatgcaaatccaaaccacaatgaggtatcacctcacttcagttagaatggctattatccaaaagacataataagataacaagggttgctgaggatgtggagaaaggaaacccttacacactgtgggtgggaataaaaattagtaaagccattacggaaaaaagtatagcggtttctcaaaaaactaaaagtggacctaccatatgatccagtactttcactcctgagtgtacatccaaaggaaatgtcctgtgtattttaagatgtttagcattatccctggcctccacccactagatgtcagtaccacccaccctctcactcccagttgtgacaacaaagaatgtctccaggcattaccaaatgtcatcagaaggtcaaaaatgaccccggttgagaaacactgttctacatacagtagggattcttgaattattgtaaaacacagaaagagtgcttttaagttgtttgaaattttattttattagaatctatgaaagtatttttaaatttttagcaatacataatatttgtacatacttacagggtacatgtgatatttttaagcaaacaagcaaaggccatttaagctcaattctcatgtgctaactcaaatacaatgatttgcaattccttatatacacactacatcacactacatatattttctatttatttatttatttttagagagagagagtcttgttctgtcacccaggctggagtgcagtggcacaatctcggctcactgcaacctccaccttccaggttcaagcgattctcctgcctcagcctcctgagtagctgggactacaggcacacaccaccatgcccggctaatttttttatttttaatagagatggggtttcaccatgttggccaggctggtctcgaactcctgatctcgtgatctgcccgcctcggcctcccaaagtgctgggattacaggtgtgagccaccgtgcccggccacacactacataacttttcatccattctcacgttagtgtttgtgttttatttcctcctcaagaatctataaaatataaaaatatttaatgcatttaaattgttgacagcaatctttgattttgaaatactttcatgaaaagcatattttctggaagataatagcattgcattgaatcctgctcctcttaactgacttgctataattattgcagagaattattttctcttgaagaaagatggtatttaaagtaaggtataactactgacctgtgtgcctctagaatgagagcaagtaagtataccaccaaaattcaactggaagtttgtagttttatggctcctagaatttattctaggagcaatttattccactattgcaagctaatctacttcacatataatttagggcaaatgaattatgtcattaaggaaacatattcatttagagttgttaaatgccttctaatagatgcaagatctgaaataatataaatatgtgcttatattaagagtcaggggcaacaaattttagagtctagaatgttataagaaggaaggtcatgtgttttatgatttgatttaaactaccctagtgattcaagttacctagaaccaataatcaacagggtattttatatgtgtatggacacacacacacacgcatacacacacacagagagagagagagagtgagagagacagagacttaaagaaattggcccacacaattgtcgagctggcatgtctgtaatctgtagggcaaagcaagaggctggaagctcaagaatgatttctatttttatgttatggtcttgagtcacaatttctcctctgggtgtcttagtctatttgggctgtcacagcaaaaataccataaactgggtggcttgtaaacaatagaaatttcttcctcacactactggaggctgaaaaatccaagaataaggcaccagcacatccagtatctgttgaggacccactccctggttcatagacagcgccttcttgctttatcctcagatggccaaaggggcaaggggtctctctcaggtgtcttttaagagtgcacaataccgttcatgagggctctcaaatccccacctcctaataccattaccttgtgggtaagaatttcaacacaaattttgggcagatacaataattcagaccatagcactgagactttttttcataaggttctcaattgactggattgtagatgttaaccatatctacaaaacaccttcacagcaatacccagattcgtgtttgatgaaataactgggtattattacagcctagccaagctcacacataacactcaccgtcatatatttacacatgcctaggaagagtaaaataaagggctatctggacattttcttgaattaccagattcataaatacagttatgtaccacatagtgacatttcagtcaacatcggactacatgtatgacagtagtcccataagattataataccgcattttattgtaccacttttatgcttggtatatttagaaatgaagtacttaacattatgttccaattacctacaatatttatgcagtaacatgctgtatgggttagtagcttaggagcaataggctacacagtaaagcctaggtgtgtagtaggttatgccatctaggtttgcattaagcacactctgtggtgtttgcatgataatgaaattgcctaatgacatacttatcagaacatatcccactgttaagccatgcacagttgtatcatgatggatggatgttcttcctataactcaatgaagtaaaattttaaggttttaggtggtgtgtgtgtatatatatatacatatatatacatacacacacatacacatatatatacacatatatacatgtatatatgtgtgtgtatgtatatatatgtgtgtgtatgtatatatgtgtgtgtgtatatgtgtgtgtatgtatatatgtgtgtgtgtatatgtgtgtgtacatatatatatataaaatatatattatatatattatatatataatatataatatatatataaaatatatattatatatattatatataatatataatatatataatttatataatatatataatatatataatatatattacataatatatataatatattatatatatattatatatatatatgggcaaactgcattgaaaatatgtgcagatggtctgcgaggctctttgacagactggctgccacatgtcagcagatgactgggcttgtgcctcacccagcaagacaggacgcatctcaggccttcagggtctcttgcaaatggtcagaactcaagggtccattggaatgcacacacagattcctattgaattggaatatcggctattcactctgtgtttaggaatactcagtatcgaggttcactaatacccatcatggaggttctatgtgccctccttggtcccctgtgtccctggacccaaggtgtgcccaccctctgcatgaagcacccatgtctctgtgaaccaagagtctgcagaggccagaaaagcatgggacccagaggttggcatttgggctaaagctcatactcagagccatgtgcagggccaaacaggtgatgaaaaatgagagcactgggctggacccaggctgaactcaggaacaggcagcagcaacaaatttccagtaatgagagtctgccagggacacagcactgtcactttcctcctgccacctcaagagttaagcctagggacagctgcaggtctcagtgcccacagcagcaccccagaactacattccaaagaggggatcagagaggaagcactttggttttttacacagctcctatttatgtgttcttatgacatgcactgtcctgttttcatggttttgttgaagttccaggtagaatgggctaaatgcacattaagactgaaaacagaatgttaaatggcatcatagacatattagaaaaggagggcttagagattacctgagtcaaccttgtgtgaaaactgagaaaaatgagaccctaacaatgttatatggtaggctgcaaaggctggctttgggtcccagaagaaaatatgcgtgtctgtgtgtgtgtgtgtgtgtgtgtgtgtgtgtgttgcttgtgtgtgtgtatagatgtgtgtatgtgggtatatgtgtgtgtgtatatatatatgtatatacagagagagtatataaggtgaatatgtacatttgcatttatatataaatatataaatacacaaatataaatatataaggtatatatatacacacataaggtgtgtgtgtggatgcatatatatgtgtgcatatatatgtatatgcagagagagcgtatatgaggtgaataggtacatttgtatttatatgtaaatatataaggtatatatatatacacataaggtatgtgtgggggtatatatgtgagtgcatatatatgtaacatatgtatatatatacacagagtatataaggtatatatatatatacatatgttagtatgtaaggtatatatatggtgtatatatatgtatatatataatatatgtatatttacagagagtaaggtgaatatgtatatataaatatataaggtatatgtgtgtgtgtgtatatatatatatatatatggtgtgtgtgtgcgcatgtgtgtgtatccggatttgctactgtctaatgaataaacaagatccagatttgaaacacaatagtgtatatgaatgttatcagaaaaagcccatcaaatttctcccacactggggcactgcagagtccttcccttctcgaatgttctccctggcacttgtgtttctctccttcctgacctctgcctagtcgcagatagagatgcattttgacagaaccgggaagagttgttctatttccatggcaacgtcaattcacattctgcaggtacattggccgccactgcctaaatgaaggctcctcaaggctctgtgtgttgccgtgcctggccaaaaataactgggcatgccaccgttcctcacagccccatggagagaggcattaaactgactggatgccaactgtcaactctgttcctgtcttcctgctaaagaggaagaaacaggaactgccagtgttttgggggaggggagccagggaggctgctacattgtttccatggtctgagaaacatcgcatttcctctgttgaatggaacatgaaatacattcttacttgttcaccccaggggcaccagataatttgtatttcagcagaagtattataattacatagtttagagttagaattaattagcatttggggaagtagtgataaaaccaagcagttattaaaaaaattaattttaatagaggtcagtttggagagagtgcttggttttcttttgaaagatttgtgtgtgtgtgtgtgtatggtgggggagataaaagaataaaattattaaatgatcctttaatcagtctgaaatgtgaactaccttatcattagacgctaccactggatgttaaaatccaaattagtggcacacatgcagaacatatttcaaaattagtcaagagttaggtgaatctttgagggttatctatgaaaaaaaaagaaagttttgtagagtcctttaaaaagtatatcatgttcccaagaatgtgggtcataacaaccttcttgacgttaaacatagtcaagaatgatttcatgtattatactagacacatgagatacttcataataattaaatattgtttgaagaataatttttgaaatcagttaacattgcctacgagtgcgctgagtgtgaagctctcctgggagggcttgtgcacccgggaataaagttgaatctttgccctcatgaggcttttactttgttttgagtgaggagtcagaaaagactgcaatttttaagagtatttttaccttcaattggagttttacaacactcctctaagttcttaaaatcaaagaccatcacagttaaattttaatttttttctgaaattgatcaccgttccgtggttgtataaaagactgtccttgttctcagaagataatgttgaaacctttggggagaaagagacatcatgtatgcagtttactctccaattgttcagcagtaacaataagtgttttcattagaatgagagaaagggaaagcagtggagaaaatgaggcaacttgttatcaagtggtgagtggaagtggaaggtatgctacagttactgtactattcgtataactgttccttcgtttatatatttttttcaaaacaataagttaatgtagtctatagctttaggcaaaaactctttttcaaggaaaaggagcagtgtgcaaaagttatttttattttttcttaaatgaattcgcagtctttttgaaaatctggaacgtcaacacttgtaaatgtatacttctttagttttcagattatagtaggaattaccctactaatattctgaaataagaagtagcctttactgatgtaccaatatttttaagcagtgccagtttctaagtaatcttttcttaacttcgcttctgaaaatttgaaaaatgtcctttcgtcacaagctataggctgcattagtttagcttttccttttccttccaagacaacacccttgccgcagtttggggccagaatgatcagctgacccattccacatctttatactctaaatcaaagttgttccctttaaagagctcattggagaggaatatgtgggatttgataagctccgttgatggtttaataattatgaatgtttaacagacattatacatttatcccacatttactagtataagagcgaaaataaggaatgaaagcaaattgttctgcagggtccatttgtgcatgctattatgccccataaagaaaaaaaatctttcataaaggatcgttagttttttcatcttatttacaccattagatgttgctgcagaacattagaatatgcactggtgcaacgtgaatagtctgtctgctatttattgcataatccattttatgcaatgtcaaaaaggaaaacaaccaaaaatacagggtttattttaaattaggagttaagctctgactttctgatgtgctaagttgaagcctggagcattttctcgctaatccagtgtgagtttctaacagtgagccctgttttaagaggaaaaagggtgatgtagtccaattaataagatggccttgttcattttccctgggatgatgaagcattggatggctccctggctcagtgaaaacagggtggaaaaacgttgatccaggaattgtaaattgagcatgcagggctctgcaacagctttcctatacttctttgggaataaggagtagggttcaccatacctgtccagttttctttgcacttgccactgtttctcttaaattgttttgggaggttgctttcattttggcacatttttgacgaaaaatgtgtgccttcaagttcatgcccaggttgtctgtcctgatcacacaaatggccttggaggttccttatgaattctgtatgcaatctgtcactgcattgcttatgtagcagttttgagtgcaaagccttgaaaattaatgaagtgcctttctgttttctgtcccaatctgtgatctggtgcctggagggtattttgactatttttgacttcacttgtttttgttgttgttgttgttgttacatacagtttttttatttttaaattctctctctaatatgttattttgcttttattctgtccattcattcaacaccatgttgacatagtttggatatttgtccctacaaatctcatattgaaatttggcccctaatgttgaaggtggggcatagtggaaggtgtttgggtcatggggaaagattcctcatgtatagcttggtgccgtccctgtgataatgagcgagttctttttctactagtttatgcaagagctggctatttaagagagcctgacacttcctgccatcactcttgctccttctctggttgggtgacccacctgctcccttttcaccttccaccatgatttgaagctccctgaggcactcaccagaagcagatgttggtgccatgcttcttgtacaacctacagaaccataagccaaatcaatcttttctttgtaaattatccagcctcatgtattcccttacagcagcaccaaacagactaagacatatatgcatagttgtgttcttagattttgttgttgttgttcccaagatagattttcctttctttttttcttttctgttctccatgtctcttcattcatattacagatgaggcacaggacctgggctgaagtatgtacggggtaggtaggttatgttctctcctctttctatgcagtcgatgtaagaatcccagcactttgggaggccaaggcgggcggattacccgaggtcgggagttcaagaccagcctgaccaacatggagaaacaccgtctctactaaaaatacaacaaattagcagggcgtggtggcacgtgcctgtaataccagctacacgggaggctgaggtaggagaatcgcttgaatacgggaggcggaggttgcggtgagcagagattgcaccattgcactccagcctgggcaacaagagtgaaactctgtctcaaaaaataaataaataaataaaaataaaaattagtggaggaaatgggcaagcgtcgaagctgagaattttctatggtcccttccctcccctgcagttctgggaatggccactagggacgcagttgtgccgttaatgggtctcgggggaggccttgcccaggtgtgaacgagggaggtcagagcactgttactcttatggcgcataactatacagtactataactttactatgataacttcactgagcaacggtacaaatcgacaaatggacaacagtttctatcattgattaatcaaataatcagaagtcaataatctgctaagaatattctgacctctactggcccttggcaatagatggagacagaacaatgccgcaaacgtgaagacagcctcccactctctcctctcccacttctcctacaggctttgaggatcaccacgtttcgctccttcattcacatgtctctgacattttagagtccagaacatcacaagatacccataatttccaatgacgtgaagtaatagagataagatttagtaggagagtaaacctacctctgtccttgctgttgtatccccagtgtgcagtggggtgacttcccagagtaggtgtgaagtcagtgtttgtggaataacagatatgaaagaaaatagactcagttttgtaagaaagaacaaggttcactcaggataagatgggcaagggaatttcttcttatgtgtaatcgctgaatcatgcataattggaagggaaagatcactgctacgttaatttcctcctgcaaacacacacactctcttcttgcaaaacagtgtaacctatctcccttgcctttctcattggagaaagctttttgcatgcaagtgtttcccccaaaagcaagacctcaaatagaatacttttttttttttttttttttgagacagagtctcactctgtcgcccaggctggagtgcagtggcgcgatctcggctcactgcaagctccagctcccggattcgcgccattctcctgcctcagcctccctagtagctgggactacaggcgcctgccaccacgcccggctaattttttgtatttttaatagagacggggtttcactgggttagccagaatggtctcgatctcctgacctcatgatccacccgcctcggcctcccaaagtgctgggattacaggcgtgagccaccgcgcccggccgagaatactttttgtaggttggtgaaagagtgacttatgtataggcagaggtgcaaagagagtgttttactggaagtgcagggttgtaactttactctataaagaattataaaatttgtagactcatgaatattagaactgaaaacaacattagtgattctagtttcatcttttccatgtttgtagtcaaggaaaccttttctttggagaaatgataaagttaaccacaatcacattcattttgaatatttttgttattaagtaacatatgctaaatttatgacatttgttttcaataagagctgtgacatggatactctaatcaagaaattaatgtaataacttacattaagctgaatttcttgtatttaaaattttatctatatgtgaatatatttttaatgtcactttttatcagccctgttaacttgagggctgtggcaaaattcctatttctttatctataaaataaggatagtatcatatctgttctgctttcctcttttctcaaaagtaactgagaaaatgtgaaagcattttatgaactataaagcaacataccatgaagagaattaaacaaatgaatataattttattattctcccaaataaatccaacctttattattaacacatatgtgaacagtgcaaaaacaagtctgatacattttttaaaggtcaggaattttgtagaatttttaaactataaaagaaacatgacatgattttctcaaacataaatttcttgcttttattctaatacgtaaataagcacaatactgataacctatgggtcagatctggcaggcttccaaattaacccatctggcagaagtcttgtgattcatggcaacatgcggtccctgggtagggtcttatcaggagttctccaattgttggcatactgtttactatgtaacttacagacactgaaaaggatcctgatttgtttcagaatgggaagaaagtctggctgatggtcttgcacatggacactttaacctgtatgttgccatctgtagccaatgattgtaacttctgtaatgtaccctccaatgaaaaaggacagctctggtgtgaggagttctcttccttctaaactttcttatagaggccttccaactcctagctgactctggaacacacccaacttctgttgacttcctgagtcaatcttcacatttagttttcaataaacctttgtcaatcgtcacgtttgatttcgaacaaatgtttatcaaaccattatcaaacctcaacagtcttaattttggtcaacaatactaacattttgagcaacttattatttaaaaattgatgtatattaattcctaaaaggtggacttattacaatgtaacaaccagtcatatctaaaatgccactagaaaattcctcataaaaatgctatctctgttgaattaataaattttcccttcaatttcatagtcttttttttagaagcctagcctatatagtgtttatttctatattggacctggctatactcattagtgattttatagtgctttctttgttatttattttagagtgctttggggggggacaattttagattctttttttatgagatggagtctcgctctgtcaccaggctggagtgcagtggggcgatctcagctgactgcaaacctgtgcctcctgggttcaagtgattctcctgcctcagcctcctgagtagctgggactacagttgtgtgccaccacgcctggctaattttttgtatatttagtagagacggggtttcactgtgttagccaggatgatctccatctcttgaactcgtgatccgcctgcctcggcctcccaaaatgctgggattatagccatgagccacctcacccagcctagattcttttagagaaagatcaaagcatgtgtaataaagtttgctttctgttctagttttgtttggtttcagaatgcatgtataaaatttttataacttcacagagtaggatggcattgtgcttgggcctcgttcctgttttttaatgtgattacatatgagttctttcatagaaattttactagctagtggtcactgtgtgtgaaatgctgcttattgactgggtccatgtctgtgtctggttttcctcatcattctgaacccactgcatattggcatttgccagtggggtgaaagtactgtacaggccttttggaaaaccaggctcaggccccaggctctgagtgagaggaacaatggggagctgtcatcccctcacctcctcccagtgaaaaatagaaaatcaaatctcctttggccacttggcaaggatctagccgttatttctccagtgtaaaagaaaagggtcttggaaaaagaccctttgctaatcaatatacgagtaggaaagattagagaggtttgacatcttgggcattaggattcactgcctgaactccttttgaattctactttgttttattttcttggaatttatggctgcaaatgactgtgctcttggaaactgagggcctgatgaaagttcttcccttgcttgtgtaacaagtgacactcacggactgacatcaacttccaaaaatatgcagaattttagagaaaaaaaccaactgcacaagttgcaattttgtacaaagaggaaacaacaataactttgtgttttaggtattagggagctcatccatgttcaggccattttaccaaatttaaaatttttaataaccaaaattttaccttagaaatgtagcattttgccatcattccttttgtcaaaatgttgtttttctggctggacacaatggctcatgcctgtaatcccagcactttgggaggctaggcaggaggattacttgaggccagaagtttgagaccagcctgggcaacataaagagaccttgtctctataaaaaagtaaaaaaaaaaaaaaaaaaaaaaaaaaatatatatatatatatatatatatatatatatatatatatatatatatatttgccgggtgtggtggtttgcacctgtggtctgagtgactcaagaggctgaggtaggtggttcccttgagcccaggagtttgaggctactgagagcgatgactgcaccgctgcattccagtctggtcgacagggcaagactctatctttaaataataataatgatgataacaacaacagcaatactaattttaaaatgttgtttgtctccatatttaaatgccaaactgtttagttaacatttttaatttgatttcaattaacctatgcttgggatctttttaccattacaatttgcatttgaaatacataatagagttattctaataatccaaaaacagacttttgagatcttttcccttctctttttgatttataaatagcatattgattcccatttaaagtgtgggtgcagtgtggctgtcagcatattccattttagtaatttcattattgatttatttcttttctaaaagttacaaaagcaatggtgatttgctttcgcaaatagaagtgactcagaatggtaaatactcacagttcatggtttcttccctgcctgacagtgtgagtcagaaattaaataaatcagtgttgaaattcctagaatggaatctgctgggacccacactgcgtccatactccatccccttctctacaaccagattaaacatactctctccatgtagggtggctccacttaggaaaataaaagtgactcaactgtacccatttttccacaggtacatttagcaaataccggtgggttttggttacaaaggtccagggattggtgctctaggagagcagttcaggaaaagggtctgtatgcaggagtggaggggcgagggggtacagagaaagctgctctgtgataggctgtccagagggcagctccaacagtctcctgtgaatgtaagttatttttatttatacatttatttttttgagacagagtcttgctgtgctctgtcacccaggctgtagtgcagtggcatgatcactgcaacctccaccttccaggctcaagagatcctcctgcctcagcctcccgagtagctgggactacaggtgcacaacaccgtgcccagctaacttttgtgttttttgtagagaggggtttcaccatgttccccaggctggtctcaaactcctgagctcgagtgatccgcccacctcagcctcctaaagtgcagagattacaggtgtgagtcaccacatccagctgtagatgcaagttatattcacaaatgtaagatggacattagagtacgtgatttgcctgctatagaaatacagcagtgtgtatgtaaagttgtaaatgccgtattttttacccgtaagacaaatagaagagctatatgctttaatgatgcataggactattttctgaaatctgctactggtgttgaatagttgcggctgtttttttaaatttatttttattattattatttttgagatgtattctagctctgccacccaggctggagtacagtgacgtgatctcggctcactgcaacctctgcctccagggtttaagcaattctcctgcctcagcttcccgagtagctgggattacaggtgtgtgccaccatgcctggctaatttttgtatttttagtagagatgggttttcaccatgttggtcaggctggtctctaactcctcaccttgcgatctgcctgcctcggcctcccacagtgctgggattacaggcgtgagccgctgggcctggccaagttgtggctgttattttaacatagaaagtttttttccaatcaaagtgtaacttctctgataatatgctttgtatttgtgatttatgttttagtaatagtagggcaaaatatttttttcctcttttgattaccactagaccaatattttttgtattatatttaaagttgatattttggtaacacaataagataaaatatatctttttccctttataaccaccaatctgatgtttccaatgtaacagttttaaaaacgcttcttcctggatatacctagtgattcctgaattctcttactgcagcctaacgactgttactcgctctttgctttaaataatcttgacacatagtcctcatcacagatccacattttctttggccatatatacaaactcgacagtgtggtgttggaaatgtgaaagggctgctaactctcctgaatctggggtcactggttatcaaataccatttaagcactttatatctgaattaagccgattttgtttgagccacttgatttttccaatgaagcaagaaggagcaaataagtggtaaaaacaaccttggcttgttttacttttcctccgtgaagtcagtgagtccggggctcccactggtatttttcatgttcatcatggacgtcccaggcagtagcacattctgagaaatggcatctaacctttcaaattgaagattttatttgctagaatattcactctttattgcttatctcaaaatcaggtgggatgagtgtcattactgtcccctcgtgcatgggcttcagatcagttgatagctaagcctagccgatgctcattcatctttgagattaacagagtagcttataaaatgcgttacacatttttgaaatgcaagcatgaagtgcgttagtaaaaaagttccttcagtaaatctttaagaatctggaaaaaagcacaagtcagtttaagagtatcatatccgtggttcactttgcagcagtgactttatatcttgttttgtgtgtgtgtggttctttgcatcattttgaacattttcttgaatgaaaatgagtcagatacagctactttgcttgtctcctgtagacacacactttgattaatagagttgttggcgaagtgttaaaagtcaagaatgttgttatcaccacacacagagggactggatatggggagtgtagtgggattttaaatgagaagcactgcatatcacaatcatagagtaactcctcgagtgattttacgtgatgagccgagcttccccaaagagtaatttaattggcatatttgaagctagaagtttctgacagccaccctgtaccttagcaacagcctgttctcttagtaagagtccctgtaaacaggtgggaaaattaaggcactccaaatgtttatcaagtgtaggacattcattatagtatttaccttttagagatatgtctgaaattccataagacagtttaagcaagccaccagctgttgtaaagggactgagaaagctctgactagtagacttcttcttagaatttaccagactttttttttttctcagaatgctgtgaatcataagactttcactaaactttcctattcttatcaaacagcaaataaactggctaaaaataactggaagaaatcttttagcatgtaacaatactcaactacatggaaataactctatcctgttttcctttgtaaaactgcaacaacaaaaaaattgtcattttcaaactgtgctgaatctctggcagtttttgaacccagctgcctgtcacggtttgagtctctgtactgtgtgagtgatgataggctaaatccacttccactgatttttctaactcattctcaaagttgtcttaaggctttcccattatttccaattacctgtgaaaaatgggcaaccaggaggtgggacacagtaccacaaaaccaagtcattgataggctcttaccttccacctggtggtggcctcagtcttcctttgaatcttctgagtaacatagcaccagagaaccatataaacagcccttgatttccagcctcagaggcagacatgagagctggtatgacagtcaactcttactatatcttatctgtatactatacaaataagggaataaatacaaataaaaagatttttttctgataataaagtaatgcatgtttccactggatagtcttaaaactgcaaatagttactgagaaaataaataaaatgcacttgcagtttcacccccagagatccataatcaggtcctctgtattgaaccattcaagggggagtccaggttccattggaacacaggatggatagcggccccagaagttgcacagctcgggtcttaaacagctgttaacatcttgtgtcacgcattatttgagcctttcgcatcgcctatgtagtttttctgttgttcttctttttttattttgctttctaaaacgagtgtcatgccatgctgacaggttaaagcttgttgtatcctgtatattttaatgtaatgcccgctaaccacagtattccacatcgagaattctgttctcagtgacaggtggactgttctcccgagggagggctgaggcaggaggaagtactcagacttagagaaggcatggagaacagggaaggcagggacagctgtgtgccccgtggccatcaccattgctgggacctgattcttgatgccctcctggctgaggagtcggccaacatccctggtacagacttggtgttattgagtgataaacaaatcctcttcctcctctctcctcgccccactcttttcttcctcttttctcttcttttctcctcccctcttctttcctcttctcttctctttcctttccttcaatgttctaagcctcagactgttcatttctagagctggccagatagaacagtgagtcacggtgagatattgtgtcccatggatttgttctaccagaaacgtttatgagccactgttggggagctctggtgctcttttgaaatatccaatagcatctttctgatgaaagcctggaagagaggttccactagtcagtgaactagcagaaatgaccaactacaatgataacccatgaccatcaattcacagtggctgtaaatcagtgccaattcagacctgaattaccaggtcaaatacggttccaagttgcacagtgaagatactatccagccaaaactaaaaccaaaaccaaatcaaacaaatacatgaaaatcagagctagatcttaatctttgtggcttgagaaatccagagaaaataggaccctgggtaagccctgaaattaaagagacgaatgttaatgacttaaagatttgtgttccagatcttcagtgtatttttgtttgagagttcttgtagctacctgaggtaaggtaacccactgaaaatcagcggatgtgcagcgtgaagttggcatctgacagctccttgatagcactgccacctgctcacttgctcattctagctacaacagttggtgggagaaacatgtgctagtcttgttataagtgcatgttaataaagttttctctgataatgcaggaaagctggggacagaggtagctagagtttgtttttcaaagataacatttctagtctggtcagatgcatccataagagggggaataaacagtgtaggctgatactcatctggtactaatatcctcttggtcgaagcatatcaggcggtgagtgaatacagggcaatgctcgaagaagacttgaagcatgggagcctcagctccaaggtcggtggagcgctctttgaatttagccctgcaacccatcagcagtgtggcctttggcagatcactctccaaaccctggtttcttcttctgtaaaagtagcataatagatattcttaatgcgtaacgttgggaagtaggaagtaaagagaacatatgcaagtgactttgtagcagatatttccttaaaggaatgctatggttctaattgtcagcatcactgtcgcaaatgagacgttcttaacctgctgtgtgccgtagagctctctggcaaactcatggagcccatggaactctcctcaggatagttttgttaaataaaaaaaattatacataatattataaaggaaatcatttagcaaattattactaatatatatgttaggcagaattatgactccccaaaaatgcctgtggcttagttgccagacctgtgaatatgttatgtcctatggcaaggggaaattaaaggtggagatagaattaagtttgctactcagctgtccttgacataagaaaattattgtggattatctgggtgagtccaatgtcatgacaagagtccttaaaagtagaaggaagagacgggagaacccgtgtcagagtgatgcaatgggaaactcgatgggccattgctggctttgaagatggaaggagaccatgaaccgaggggtttgggcagcctctagacattggaaaaaataagaaaatagattctccccttgagcctgtagaaagaagacggcctgccaaccccttgcttttagcccagcttgacccattttggatttatggcctacagaactatagataataccttggtattcttttatgtcatcaagtttgtggcgatttgttacagcagcaatagtaaactaatacagttatcaaattagataaaatccatgatgtatgatatgttcttcttgattaatttattaaatgacacactagatttgtgtccatagcaaattttaagaagttattagtgtcaataaaaatgtatagagagctatatctgaaatgtgattttgaaaatattagtaatttttattgatgatgaagtcacagtactaatactactgtggtttgttgcctatattaataattttaaaacatgataaatttcagttagaggttagtgaaaaatagaacaaatgttttcctatacccagcttcagggagcttcctgaattttatgcatagagggtatgcaggccccagattaagagtccctggtttagatatatgaaagaatgagaaaccttctaagttcttcaagatatatacaattcaaaagcaaaattagaaaatcactgcagccggaaagaacattaataatccattagccggcgctgtggctcacgcctataatcccagcactttgggaggccaaggtgggggtggatcacctgaggtcgggagttccggaccagcctgaccaacatggtgaaaccctgtctctactaaaaatacaaaaattagctgggcatggtggtgcatgcctgtaatctcagctactctggaggctgagacaggagaatcgcttgaacccgggaggcggaggttgctgtgagcagagatcgtgccattgcacttcagcctgggcaacaagagcaaaactccatctcaaaacaaaaaataaaagaatacgaagcttaatgcctttaaaaatttattctcatgagaaaagaggcagctcatggatgacctcagtgaaatcagtacattctctgtggagacagtctttatatatcacaatgaataaaagtagggagcataatttttaaaaatggaggactcaagacacagattgaaaaggggagcacaaatataaagctcacaggaataatactaaatataacacacctgggtagaaacgcatcatttcctctagtgtttgggacagaagtaataacaatacttcaaatatgtatttgaagaatatatattttaatatacaaagaggtgaggttgtcacataaaatagaggatgcccagttcaatttgaattcctgataaacaaaacataatatttagtgtgagtatattccaaatattgtgtggagcatacttatcctaaaaattatgcattatgtaactaacatttagattgaaatggtgtcctgtattagctaaatatggtaaccctgctgagaagagactactaattctacctttaggctgtatgaagtaatatttgcagtaatagatattgtttggagtatctctgcaatgaaattctctttgagcttgctctctttaaaaagagaagcctcgtgctgcatacctaccatattgcctctccaagcccactctttccctgtcttcaccctgctctgagccccaggaggctggctgcctcaatgggctcccaggtcatgggcttcctaccaggttccacaatgggaggcatcagcaggagactatagggcagaagagcagtatcgttagagagttgattttgtttcacctgctccttcccattcaggttgctctgaaaccactcctgcccactaaccctccatgcctagggaagatgacagttttgagctgctcttagcccctgggtactgcactggctttgtaaattgcccctttattaatgattgagcttgaaggtgccatctcttcccttctggagctttaatatgctgaagaatatgatgtagatctccaaggtcaagagtaccgtctgcatccatgaagctgtgaattagaaaaagaaaagtaagatttggaaagaaaatagttaagttgacattcaatagtgaggtcttgctggtcacttaatctctcttttaaaacagatatttattcctggaaggtttctggaaaaattaatagaagcaggagtcttaatcagttgaaagacataaagacatagactacagaaataagcagtttattactagaatgtctatgttactcataaaacaagacataaatcctgtatttatgaaatatatgtatttaaagggctttcttcagaaaacttaaaaaacaaaatatttagaaactatttcataaatatttaggaaaaaggcaaaaagaagcaaatcatgtgttgtcctgagacttttttcctgcaatctcccttttctcctcctccctcccagtactgctgaagttttcttcctaaagaagggtactcagccgggcgcagtggctcacgcctgacgcctgtaatctcagcactttgggagaccgaggcaggtggatcgtgaggtcaggagatcgagaccatcctagccaacatggtgaaaccctgtctctactaaaaatacaaaaattagccaggtgtggtggtgggtgtctgtagtcccagctactcaggaggctgaggcaagagaatcacttgaacccaggaggcaaagattgcagtgagccgagatcgcatcactacactccatcctgggtgacagagtgagacactgtctccaaaagaaaaagaaaaagaaaaaaagaagggtgctcagatcttcacctccagcacagacacttggatgacttccttctatgcatctgagaagttttcaaaaaatatttgctaaatttaattgcatttctgcttctttaacccaactgtcttagatatggtttggaaaagagcaagagaaaagtaaagttaaattccctaattatttcttaaactttccccagaaacttaatgggcacgttggatcatagtttgtcccacatagtaaatgagacacatgcgttgctggtgagtgccttcttaaataagaacagagatctttcatctagaggctggcacagattggaaggttctggctgctatcatcctatatgtagtagagttttggtttttttgtttgctttaatctgaatgtctgattgaggtattcaaagagcaagagagaaacctgtgaagagatggactatttgtgtcagaactgtttaatcttgtggctaggatcacttgtattgttgagctagattcctcaatagctgtctagatatttgacatatggtgttttactctattgtggtatatgaccacataaacagataaaatagtagtaatcttttcaatcttttatagtctgcaagtattcatacacttatttcaaagtagtctgtttctagcttaggtaaatttagatgatttcattgaatactgtattaaaaacctgcttcattccagttaatttttttcaggaattattactcatactacaaggcattatttatagctccagctctcttacatgataaagaatgagctgcgtattacattgctataatgagaaattctcttgtgtttaaattaatctcccttcttagcattgagaaattctgtggattctaaaattctatttgagaattgtaagaatgttttattactctcttataatatgtaccatattttttctctcatatatctgtcagtgatgggtatatatatatatatatatatatatatatatatatatacacacccatatatatatatacacccatatatatatatatatatatacacacacccatatatatatacacccatatatatatatctatatatatatatatatatatatatatatgggtatatatatacacacacactatatatatatatatacatagtgcatatatacatattatatatatatacacatactgtatatatattcatgtttacataggtatatgtgaaatacatgtgcttataaatcctgaacaatgccaggcagctgtttttataatcttgctggtttatacagaagtcagtttctaccacctttcttccaatcctagggaagttgtctctaaaacacccatctacagcagaaagggaagcccatgggccagccactgtgtggttttttatacgcattgctttgtttagtcctcacagcagtcttgcagagcaggtgtggcgtattcccatttttagataatcaaactgaggctcactgaaatacagtgagctctttaaggttactcagctcgtaatggtgggtcattgttgccttcatatacaattgacaatagtaattcctcctggcaacaaaatgagatatgtcctgaactctcattgtgaaggaggcactgtgccaaacatttaagcagcccaatgacacagagttattattcccgttttataaatgaggaaaaccgagacacagaaaggttatgacatgtgcagattttgaaacccagatctaatgccaaaatccatactcttaacactttactatgcaacctaccatgtgctagactttgatgagtctgttggattatactcgaaatccagtacttcatatttcataattttagtggtttcaaaatccacgttattttgaccaattccaacatagcagttctcatagctggaaatacaagttagaaatcagcttccatttagtgatgcaaaactctgcaaaggcaaatgtatgcaagctgatctttatgaaaagcaatcccaattaactttattttttaaacaatttatttgtatattgacaaataaatgtatatatatttattgtgtacaacaggatgttttcttatatgtatacattggggaatggctaaattgagctaattaacctatgcattactgaatatacttatttttatgctcagaacacttcaaatttactctaagggcttttcaggaatacaatatgttgttattaattgcagtcaccgtgttgtaggatagatttcttgaacttattctttctgtctgactgaaattttgtcgtctttgaccaacatctccccaactccccacccctgcccccacccctggaaaccaccattctactcactacttctatgaatttaattcttttagatttcacatatgagatcaagcagtgtttgtcatttgtgtctggcttattttacttaacataatgtccttcaagcttagccatgtttcaaatgacagaatttccttttttataaagctgaatattatttacttgtgtaaattttctttattcttctgttgacacttaggttgattctaatttttgtctattgtgaataatgctgcaatgaacatggaggtggagatatctcttcgatacgctgatttaattcacagcctttggatatagatccaacagtggaattactggataatatggtagttctatttttgattttttgaagaacctctatactgtttccaaaaatggctgtaccagtgtaaatttccaccaatagagtactagggttctctttgatacacatcctcaccaatacttattatcttttgtctttttgataacagccatctgataagtgtgaggtgacatctcattgtggttttaatttccattttgctgatgattaatgatgttgagcattttttcatgtatcgattggccttttgaatgtcctattttgagaaatgtctattcaggttctttggccattttttaattaggctatttgtttctttgctattgagctgtttgcattccttatatcttttagatattaatcccttatcagacatatggcttgaaaatatattctcttattccataggttctctttgctgattgtcttcattgctgtgcagaagctttttaagttgatataatcctagttgtctacgtttgttgcctgtgcttttagggtcacatactaaattcattgccaagatcaatattatggagcctttcccctgtatttacttcaagtcttatgtttaagtgtttaatccattttgagttgatttttgtatatggtgtgagataagggtctaatttcattcttctgcatgtggatattgttttcccagaaccatttatttaagattgttctttcctcaatgtgtgttcctggcacctttgttgaaaatctattgactgtaaatgtgtggatttgtttctgggctctttattctgtattctgtgcaactggtctgtgtgtctgtttctatgccagtaccatctgttttggttactgtagctttgtatatattttggaggcaagtagtgtgatgcttccaacttgttcttttgctcaagattgctttggctatttgggggtcttatggggtttcatatacattttatgctaatttttttctatttctttgaaaaatgccattttgatagggagtgcattgaatttgtagatcactttgggtaatatggacatcttaacaacattaattattccaatccataaacatagaatatttttcaatttgtattttcttaaatttcttttaacaatgtcgtagtttttagtgtacagatttttcacttccttggttaaacttattcctagatattttactattttttggcagctgtaaaaaatgagactattttcttgataacttttttggatagttcattgttagagtataaatattctactactttttatgtgttgattttgtattctgtaatttttttgtatttatctattagttctaatagttttatggtggagtatttagaattttctacataaaagatatgtagcctgcaaacagtgacaatttaacttcttttttttccaatttggatgtttttaattcctttctttttcctaatttctccagttaggacttccagagaagtagaacagaaaggacaagagtgggcatagttattttcttcctgatattagaggaaaactttcaatttttcatcattgtgtacaatgttagctttgggtttgtcacatatgccctttattgtattgagcaacattctttctatacctaatttgttgagaattttatcatgaaataattttgaattttctcaaaagccttttctgcatctattgagatgcacgtggttttccccttcattgtggtaatgtggtgcatcccatgtattgatttgcatgtattgaaccattcttccattctagggaccaatcgtactgatcaaggtgaatagcctttgtagtgcgctgttgaatttggtttgctaggatacgggcctgcaattttcttagagtgttcttgtctggctttggtatcagggtaatgctgaccttgttaaatgagttgcaagcttcacctcttagactttttaaaataatttggggaagattaggattagttcttcaatatttcatagaatttatcaatgaagccatcaggtcctggatttttccttgattagagtctttttactattgactcaatcttgttactcatctctgatctattcagattgttatattcatgattcagtcttggtaagttgtatgtgtctagatatttatctgtttttttatgttatccagtttgttggtgtataactgttcatattagctttttataatccttcgtatttctgttgtatcaggtgtaatgtttctccttttatttctgattttgtcttctttttttcttagtctagctaacgatttgttggttctatttttgaaaaaaaaaaacccaactttagttttgttgatcttttctattgtttttctagttctattttatttgtgtttgtactgacctttattatttcctcccttctaccaattatgggcttagtttgttctcctttttcttgttccttgaagtgtaactttaggttatttgaaatcatcttttttttttaatttaaaagtttttttgttaaaaacttctttattagaactacttttgctacatcctataagttttggcacactgtctctgttttcattagtctcaatgatattttagtacttaaaatttagacgtaaaaaatgacctattaatttcttctttgacccattgatcattcaggaacatgtttaatttccatgtatgtgtgaatcttccaaaatttctcctgttattgatttctagtttcataccattgtggttggaaaagatacctgatgtgatttcaatctccctagatttgttaagacttatggcctttcagtctatgcatgtccttaaatctgaagtgactgtcttacaagcagcacatagttgggtcatgttgtgttctttttaaatccacttatccactctttgtctttttgttgtaaaatttaatccatttacattcaaggtaattgtaaataggtaaggacttattagtgtcactttgttactggctttctggttgttttgtagatcctttgtttctttcttcctctcttgctgtcttcctttgtgattaggtgattttgtttagtggtgtgctttgatcctttactttttatctttgtgtgtctactataggtttttgctttatgattaccatgaggattacataggtggcttatatttataacaggctattttaagctactaatgacataactttaattgcatacaaaggctacactttcacttcgcccaacagtttatatatatatgtatatatatgtatatatttttttttttttttttgagatggagttttgctcttgttgcccaagctggagtgcaatggcacgatcttgactcactgcaacctttgcctctcgggttcaagtgattctcctgcctcagcttcccgagtagctgggattacaggcacgtgccaccatgcccagctaattttttgtatttttagtagaaacagggtttcaccatgttagccaggctggtctcgaactcctgacctcaggggatccacctgcctcggcctcctaaagtgctgggattacaggtgtgagccaccatgcccagccagttttctatttttgatgtcacaatttggatcttttaatattgcatatttcttaacaaattgttgtagctaatattatttttaatggttttgtctttgaaccttcatactaaagatataagcaatttacatactaccattacagtattagagtatacttaatttgaccatttacttacttagactgagttttaactttcatatattttcgtgttgtttattaatgttctttcagcctgtagagctccctttagtgtttcttgtaaaaggggtctgctggtgatgaactacttcagctttatgttttcctgggacaatttttattcttcctttatttctcctaataataagctaatatttaaaaatgtaaaattttgacattaaaaatataagtgttggcaagagtaaaagtatagagattttgtatacaattaaagttatgtccttttctgaaggacaggtttgttgaattggcagttttttctttcagcattctgcatgtatcatcccacctcctcctggtttgtaaggtttcttctgaggaatctgctgctagctttattggaacccctttatttttgattcacttattttctcttgctgttttcaggctcctctctttgtctttgatttttgatagtttgattatagcatgtcttggtgtagtcttgcttgcattgaatctgattgaaaattttgacttttctgtacctgtatatttatacctttccctagatttggaaagttttatactattagttttttaagtaagtgttctacctcttagtcttcctcttctttgcctcaaactcctgtaatgcaaagatttgctttcttgaattggtcatataattccatgtatactttcttcaaattttctcattctttctttttttctgttctaattatataatttcttctttaagttcacagattctttcttctgccttatcaggtctactgttgatgacctttattgcatttttctgctcctcgattgtattttctagctccagaatttgcttttaaaaaaaaatgtcaatctcactgctaaatttctaatattgatcatttattgtttcctgatctcagtgaattgtttctctgtattttttgaagagttctgaggtttcttaaaaattttttgaattatttgtgagaaagatcataaatttctagttcctttagagttttattttatttctttggtcttggaatctgctctgggagtgtggtgggaagtcagcctgttctcaattagttcttttttcttatttttatataactggctaccaatgacctatattcaaatagaaagcaagccaatttcttaatttaagtggaacttatcctcattatctataatctatacctaataacacatgcattataaagtagaatttatcaaaggctctgaagcactagaataggattttttttttctaaagcaatggaaaaatcacttgatttatttgaaagatatttattggttacttattatactctggtcattattctaggtgtcttagatatttgagtgaacataacagacaaaagttttcctttatgggatttctgttgtgggaagaagggtactacatcaaacctaataaatatgtaaattacatagtatgatcaaatgttatgtgtagcatgtgtgaaagaaatgagacccccgggaaggggggttgggagtgatggcataggggttggcaatagtcagtgggggcaaaatgcttcaaacagggcttgctgagaaagtggcatccgaggaaatgcttaaaggaagggaagttgctggtgaaatgtatttagaggaagagcttttcaggcagagagagaagctaggcaaaggtcttagggcaggagtgtgactagcatgttgcagaaacagcacaaaggccagtgtgcctgggttgaatgaattgggtgtgggggtgtttatagaaggagggtaggtaggacagagaggaaatgggagacaggttacctggggtattgcagcccttggaatacccttgaatggtacagggtacttttgcatggatttgaacagagaatctaatttctgttttagcaactgcagcagttgctgaactgagaaaagacagaggtgactggagggtgggggtggcgtgcaacactagaaagaggcaggcctgcaagggaaaattgccagagtcccagcaatgcttgacaataagagaatcgtggcaaaaaggttaggcagaagcaatcactctctggtcatattttgcaggtagaataagtaggatttgttgacaatgtgaacaggagatatgagataaaaaaagagagcaattaccaataacctcccagaattttgccttattacctgtcaaagagaaaaatagatttttcactagaaagcatttatttttaaaaaagaataagagaacacatttgaagtgttcgtaattaaattaattttagactctaaaattgcactttcttttatgatatcgtaagacaaaatactttgaaattttacaaacatcttaaaacacgggggcagagactcacagattttataagctggtgaagttttatgtttgaattcctcatgtgcccaagtcacgtaaaagaataatggagctcatccatgtcatctgtagtttaaaaagtgaccttaaatctgttttaattaattattttgccaaagtttggcaattttagagaaagttgaagaatgatttttacactaatagaagtcagcaaaaatccccagtgacaaggaatccttgtgtgaatagagaatgctggtgtttatactgacacattttcatgtccatgagacagaaaccttgcaggacagtgggagagaatgtggggataaaaactaagcaaagaaagcacattaacaattggtcctcatcctaccaagtgccagaagctcctgcctgcactgccaaatggctctagacaacctctttgtgacgtcagggtgggggtactccagccagacctctctcaaatcttttctcaagaatgaggtggaagttaaacaaagacttcccaaccctaacctccttcctctcacatacccttacctgattcctgcatggagaggaggatggtatgtgatccatcagccacacagtgggaaagtaatatttcaacatccatgtaatgaaaatatactgtgtgaacctacatagtaagtaaaagaaattaaaatgtctagaatccaattatagattccatttttttaaaaaaatactgtatttattgtgtataacactgtccttagcaaatcacatagacctactgatatggtttggttctgtccccacccaaatctcattttgcattttatctcccataattcccacgtgtcatgggaggggcccggcaggaggtaattgaatcatgggggtgggtctttcctgggctgttctcatgataatgaataagtctcaggaaatctgatggttttataaaggggagttcccctgcacacgcactctcttgcctgctgccatgtaggacatgattctgcttctcatccaccttctgccatgattgtgtggcctccctagccatgtggaacagtgagtcagttaaacctcttgcctttataaattacccagtctctgatatgtctttattagcagcataagagcagactaacacacctacaaaatcttacgttgtatcctaactgaataatatatctttgatttttatttccatttccaaaatttaggggatggaagatgtcttagggttctctggagaaacagaaccaatggtacttatttttttttttttttttttttttttttgagacggagtctcgccctgtcgcccaggctggagtgcagtggcgggatctcggctcactgcaagctccgcctcccgggttcacgccattctcctgcctcagcctcccgagtagctgggactacaggcgcctgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccttatttatatatagaagatatttattttaaggaattggccaacgtgattacggaggctgataaatccagaatctgcagggtgggccaagaggttggagaccttgagaagagcaaatgttgcagtttaagttcaaagtcagcaggggacccaggaaggaactgatgttccagtttgaaggccatcagcagaagaattattttgcttgagggagctcagtttcctgttccatttaggcctttaactgattggatgaggtcacccgcattagggagggcagtctgctttgctcagagtccactgactaaaatatcaatctcatccaaacacaccctcacagaaacacccagaataatgcttgactaaatgcctgggccccctgtggcctagctgatttgacatcaaattaaccatcacaaaattttcttttctttatgcaaattttatagcattacttttgtgttgtggttttttagaagcatagacctagagaatagtgcccatgacctctgactatcctattatacatgaggattgcatagtatggtagaatctcctataatattctttccacgtggctgcagaatctctgtgaattctctttgaaatcgctgtgaactctcttgaactcatttttgttggcttttggtggggaaataactagaatttaaattgtgtccagtaaaggtgattctggaaatgaagccaaggaaaaataaaccatttgcttaatctttcaaggggcacaataattggaaaagacaatagtgaaataaagctttttcttttcactgttcgagctataatatccctcccaggtgagaggtattctggctgtaattcccaagggaacccttgtcacagtggcgtctttagtgagatgatttgatttttaccttttttcctttgggtggatgcctttctcctcttcttgactgtgcatgtgtcactctgtgcccacggagacagaaaagaataaaaagcttacctctccccctgaaatgcagcagagtcaaacttcagagttcagcagtttctcattgaaactatcaggcaatctgatgcagaaagacaacctcagacatgactgagccttcaaatagaagtttccagagaccaaacgtctcttttcctggatccccgatatggagagaagccgtgatctccacagagacttccaagctctctggcatcactttagcagagcagcccttgctgcggaagcagaaactcagagaggaagggctttgctgctggggctcaacaaaggtgtccgtctccagccagccactgttccaggtgcggagtacagagagggcgacacactcatagagttggtaagttcattgagaatgggtgcataacaggaaaagttttgattaatgtggagccttaattcaaaatgtggtccctgaccagcaagatgagcatcaactgttagaaagacagaaacatcaacccctctctggatctcctgaaccagtgcctgtgttttcataagataccccagggatttgaatgtgccttagtttgcgaagtgccatctagagtgtacaagaaccagaatgtacataaatttgactctaatcaactggcaatggcctcttcactatgctggctacaactctcttctctctcctgtgctccttatctcagtgaatagcagaaccatctatgaaaactcatgccaaaaacctggatgtctccctggaaacagccctcaccctcaagcagcttcataggttctctctagaatgtttctagaagctgcccatcttcactgcctctcccctggttccgtctctaagattattaactttctcacgggcttccttgccttcaccctcagcccttccaatggattccccaccctgcagttatgctgattttgctaaaattcaaatcttctcatgtatccctctgctggaaatggttgagtagctctgattactctcagcatgaacccacatgacttggtgtgacttctacctctctaaggatgtggctccagcagccccctccagcctcacctcatgcaacacccaagcctgcctgagagacaatagcagtatgcttcactggtgaaatgttttatagctacctggagtgcttaccctctacgtgtgagcaggcagtctctctctctctctctctctctctctctctcacacacacacacacacacacacgcacgcacacacgcacacatgcacacacacagagagagagagagagagggagagaaagagagagagagagagttacaggttatagagagagggagaaagtgctttctcaccctgagattattccatgaacccatagataagtcagaaccaggaattacataaaaggcccatgaaaggttaaatttaaaggatcaaacctttgtgctaaagaccctgcttcaaacatgtggagttcctcatggtcttattctctgagtctgcatgttgttgttaccacctgcttacctggtgctcccagactgttagaagcagaaagtgagaccaagcagagttgctaaaggcaggcactgatgaccccatgccagcaggactggcacccaggaaggagcagaagtactctagggagccaagcaggagctcagcggaggccagggtgagggcaggtgtcctacaaatgtcaactccgatggtagctgatttcaagctctgtttgatgacagatgttgatcccagtggtttcaagcttgagccattcaaggaacattagaaactagaaaggaaatattgcataggttcttcaaatatcagtttaccccgtgaaaattcaagctttagtcctaatgcttaaacagtgctgtattaaggtctgtgtgcacttcaaggttaaaacctgaactgtaaaatatcattttttacagttatgggcccttttatgctacaaccccagaccccctgagggccttctcattccttccttctccttccccctccctcccctgccatcccctcctctcctctcctctctccttccctttcctcttttctttctctttttcttctttccttccttcctgcctgcctgcctgcctcttttacttgacatttattggtgagtaaatactccatgccaggatctgagtttacaatggttggtggctaggatggacagtctggagtcatctgaaaaaggacagtcaagaggggaaggaccagccagtataaaggctgtgagttgaaagtcatagagagagtagtggaaagaaaggcccaggataaaccatgccgggtgattatcccaagtcctggtgaatgcatttcatgtgctttgttgactgtgttactgtatattcactagcaactgagtggataggggtctctccttatagttgggtgatctgttagccatctatggctgacctctaggaatcagggagggtcttttgatgtgtaatttgaatattagctatatctcaggctttatttttgctgccctcagtttatagtacgtagttttgtaagctgccttaaaaacttttagacacaagcaagttaaaagaatatgcagtagatttaaatgaggctcctatttaaaaacatttaataaaagtaatggtgtaataattgtgttggtagtcaaaaggtaaatttcagactgtgtgtatatgtgtgaaaagtcagtgtgtatgtatgtgtatgtatatatgtgtgtatataaatatataataacatacaatataaaatatacatttgacacacaatttaagtatacaggtttaagatattttaaagttaaataacaaatagaaataacatatgcatgtaagtaacatctaaattgttctatttaagtatgtaatttataaaataaaattatttaaacttaaatacattttatttatttatttgttattggtggattcaaaaactactgatgattagccttctgtattagttccttctgtgtctggtagaaagtcagtgtgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgcggtggcgggcgcctgtagtcccagctactcgggaggctgaggcaggagaatggcgtgaacctgggaggcggagcttgcagtgagccgagatcgcgccactgcactcactccagcctgggcgacagcgaggctccgtctcaaaaaaaaaaaaaaaaaaaaagaaagaaagtcagtgtgatattgaaatatgtagagtggctgactgtgttttatttttggagggtggatgcaaagggggtagcagggagcttagtagcaagggacctcagtgagtcttgtgttgtcagtgaggccagaaattgatgtaggcggaggaactaaaacctagttcttcaattcctctgtataataacataatgagactctggaagcgtctctaaaagctgctggaggaagcttcaaggacatgcagatgagtggaaatgaaggagcaggagcaaagaaaggtgacctccatgacagagcaggaagctacaggctgggactgttggcgtcaccaaaacattctctgcaggagggatagacaagaacttatagatgacagcatctaccatttgattttaggattttttcagtctttgcgctgtgtggcaattgtcctcatcctacatctccctgtataaaacaggtaaccacagcagacttatgtcagcagcactttggggaatgagggagagagagttgcattttatgcttggcctcatgcaagctggagaaagaacagcagcttcaggagatgacgcagtggcaggaaccagaggaaaaaaaaccacccatgaacattatccaagagtttcttttttaggtgataaaatcatgagtttcatacaaatagcagatgaacattgagtcaaatattttatttaactcattcatgaatgagggaattgctaagatgttgcaactggttccattgaagattctatccacagagatttgttttctatggggcaaaatgtatttgcagcactgagaacaggagtcctttgccttgctatggacaggaagtgttttcattgctttatgttttctatcagttaacctctatctctgcagagttgtaaacagtcaagtcaaagacaagctaaggtatagataggatggatggatgaactggatagggcatttaatgcccacttactcaatttctgcccacttccacctttcacaattctgccggacaatatatttgagacggtgaaatattcgggaagcctctggacagacccataaatcgtagtctttggatgtggactttgtttataggtggggaacctgctgaagattagatgagtttgggtgggttgagacattctcgaaagcaagaaccttgtctaacatcttttgttgccgaggacctacatcctgccccgtagaattaacagttcgtaattattggccaatagccaaaatgtcaggattaaaattgcttacctctcagaaaaattaaaaatacttcctcagccttggtaaggaaagaagtgattaaacatctagagttttaactttctattaaaattttaaattggaaagaaccatagtcatagaaagcattcacagcaaactttaggaacacacaaaagacacgtgtgtaccagggagcccacgcacgtctgggtactattgttaaaatgagaagaactaggcacactaatctattccagggataggatgcttgaaatggacaaatagtaatctaggtttattaatgggtattcatagttgttaaaggaattatatataaataatttccaacaaacagcttaagaaattttaacttatgtttaattataacatgcctccgttatacaggaaaataaaaagaaaaaaattatcattgtgtaatcaggcaaaaacatcatggcttgttgatcctcacaataatattgttaggagaaatagctattaaagatataattcccatggtaatttcctgttgaaatgtttggccagtgacactaaaaccaagccaacttaaataaatatattgcccgtttaagttgatttcacttaaaaataacccacagtaatatcataaatgcctaaaaccatacttatccataataggtagctgttttttcctccttactattcaaatagattcgacatgaaatgaaagtaaaatctcacaatggtgaaagacttctggaaattttaaaatagatatttgctaatttgtaagtcctgcaagatcatgaggagtttgtgcttttctgcagatgcacctgcatgtttacttttcccattaaatgacatttcttctgtttctaatcttctagagatgcagaagaattgcgtgggacattttaaaatattagtcacaactaatttgtcatcaaattttgtgagatctttcactgacacagatgatcagtatataaaaagcaagtcaaatatactttaaaaaataattacatccacagcaccacaactctaccttaataaaaatttcacaattaggcgggctgtgtgtcattagcctccctgatagcattcagtgtattgtcacctcatgttcaagcacacatctgatagaagcaagacattctgccacctcattccaccttctctattttacacctttaaaagtgtggaggtagtgtgctaagagttataaattgtcttgctgaaattctttgggagaaaacatagggggcttccatataaaataaacagtgagactcaaaaattctagaatcaaacatttattgccctctgctgtcagggtccacctcctgggaatgtgtgttaccttttgctctaattctttttgaaatgtctccagagagtatgaaaatgtagtgatttctctggttttgattttcaaaaccaataaagtttttcctttagtccaatttttaaaacacaaaatgttttcaaagtatacccatgttgtagtgagtaaaaattctgaaaaattctctatattaaaaaataaaaataaaaaagttgagtctagaaggggcagagagcaaagaacagtgtgaaatatctacagatgacaaagacagtcattagctttattattttgggtgctaggcacgtgttttcaatgtagttatactctcccacagctataagggcataaagctacatgttagaaaaagtgcttctgacactacataagtgtacaatagctacgtttagaactgttcagtgtggtcatattttaaaattatgaaatgtagggaagaaatgcaattatgtgaataaaaagactggaaatggtcttcatttctatgcaaggatggccacaaaaaaggtgacatggagccattttcatgtacaaataaatgagaaataatctcacaaggaggtgagaggctgcacttgctcttccccccggagtggtgttgccatggtaattatagtgacttcagacacttctgagatttctggtttcacactcaactgggaacggcgaatcgcctctatgggtgacaggatccactttggatcaataagcagtgcacgtgtgttccgggtctagctctgcctttcatttgctgtagcttcataaattgctctgtccctcactcaactgtgacacgggtcctgtctgccactccgggttgttatggatggagagccaaaacgcagctgctcaggaagtaactaggcagtgcatgtgggttaggatggcaagatttagtctcatcatttgttgtttccacagttgaatatagttctggctttattatgaactttaaaaatcagaagaagaaaatcacactttcgtagtgttgttggattatttttggtcatttccactcatactgaaaaatgctgggtatttgagtccatttcattgttcctgagcaaggctttcctttgctcttgtgagcttttttttttttttttttttttggagacagagtcttgctctgtctctgttgcccaggctggagtgcagtggcatgatcttggctcactgcaagctctgccttctgggttcacgccattctctgcaagctttgcctcccgggttcatgccattctcctccctcagcctcccgagtagctgggactacaggcacccgccaccatgcctggctaatttttttgtattcttagtagagacggggtttcaccatgttagccgggatggtctcgatctcctgaccttgtgatctgtctgcttcggcctcccaaagtgctgggattacaggcgtgagctaccgcacccggcctgttcttgtggtctttctacaggaagtgacttttgctgcagggagcttctgttgggggaaaaatgaatttaatagttttgaaatagtgggttttaaaaagtgtatgcccaagtttatttgacttacagttttggaggctgagaagtccaaggtcaaagggccgcatctggtgcgggccttctagctgcagcatttcagggtgtagggcatcctaggcccagagggcaaaagcatggcctaaaagagttgtttttttcccagatgagaataaattgttaattctttcccaaatcagtaattttggtaggttgactaaaatgttttctgattgcatcagagaaaagatataaatattgatatttagagtgccttttgaccttgagccagtatcatctttaaggtccagttatgtgaaattcaaagtgtcagtgataatggccttcctaatgtacattctttactgtcacttaaactttctgcactcaaaaccatgtggcacatcgctgtttaatatgacagtccagcacgaggccttacattcacaaccttcagtagcaacagcgtcaaatttctatcatcaaaattgtagcatgtaaatatgtcacatgaagataggtttcaatacagaatgtacgtgagagataagtaatgtctacaaacattaaaaattcctcttgactatgtttcaagtttctagaaaatgaagtatgatatttgcaaaaatatagcttcaatgtgttatgcatagaacttaatgtgtgtgaggctatgaacaagactgtctcagtctctgacctgttatttgttcacactgagttcagatttttaaagggaagaataccaggagggaaagagcaatactctctcttccctaaaaggctttgggaaatgctttatctcatgtgttagtgattctttaacttttgtgtatacagccacatctagaaagagactatttccttttctaacaggagcctatagatttctaaaaggagcctaagtcagggcacaaggaactgcctctgggctgtgaggctggagcagcctttgaacaaggactcccagagaaatggcgtttgaccttcctctgcctcatttctggcgttcttgtttcttaatgttgggtgcaggcagtttctgtcacagctgactgagtttgggggtaaaatattgtggcacaatatttagttttgtttaattaaataaatgacatggtaaacaaatctcatacatgttgctatcatttacctggcacaaaagaccattagctgtgtgtgtgagtttgtgtgtgcgtacatgcatacgcatgtacacacacatatgtctgaaaataagattcaaaatatttacaacttatttttcttcactgctaggatattcatttttactgctgacagatttttaaaaatcatgtcagtccatgtggagaatcccatgtgatatggtctggctgtgtccccacccaaatctcatcttgaattgagctcccataatcccctcgtgttgtgagagggacccagtgggaggtaattgaatcatgggggcaggtttacccatgctgttctcgtgatagtgaataagtgtaatgagatctgatagttttataaagggaagttcccctgcacactttctcttgcctgctgccatgtaagacatgcctttgctcctcctttgccttctgccatgattgtgaggcctccccagccatgtggaactgagtcaattaaaactctttcctttataaattacccaatcttggatatttcttcataggagtatgaaaatggactaatacatatgtgagatgtttctaaggggactaaggaattaagcatatcagaaaacatagatgagcagatgttacccctgcaccgttaatgatgatgatgattgtgtacttccctgagcagatggaagcactgggctttatagggtagtaagagctgagtttcatgtccaatggacctgagtggtgagtggctttttcatcttggttaaattactcatggccatgtctctggcttcatcacatttaattgaggacaataatagaatttataggattacttagacgttgaaatgcctcattgcaatgaagcacttagcacagcacctggcacataggtgggcttctgttcttacagcattcttcccccttatctgcagctccactttctgcagtttgagttttccttgatcaaccatggtctgaaaatacatgagtgcagtacagtaagatgtttagagagagagagaccaaattcacataactcagaatacagtatattgttttaattgttctattttattattatttattgttgttaatatcttactatgtctaattttataaattaaactttgtcacaggtgtggatgtatagaaaaaaacaaagcatataaaggattcagtactatccgaagtttcaggcatccattgggggtcttggaagctgtgtataaggcagggctactgtatttgttattttgttgcagtcattgtaattagttgtagttgtggtagtagcagtaataacagtagtgatcattgttagatttatagttctttgctcaaaatctcagttcaacacctgaaattaaaaatcctccctattggccaagaactgattttttaggatgttccatatattttgaagattatatgtaacaaaaagtggctataattttagtacaatgtaactttttacaatttgctattttatttggtgcatagaaattaaggtcatgcaatcactttggaaaatgaccaatctttttaaaagctggctctgtgcctaccctatggcaaagccattccactcccagctatgtccccaaaagaaaaaaatatttacctatgtccacatgtactacaggttcccaggtacacacaggcatatacagtgttcttggcagcacttttcataatagctccaatcaaaaaactatgcaaattcccccaaacagctaaatggagttatgttcattcaatataatacagctaagaaatgagaatgaacagccaacaactacacacaaccatgtggataaatcttgaaaaggtaatgttgaaggaagagagacagacacaagagaatatattctgtgtggttctatttacataaacttccaaaacaggcaaaacgaacctatcctattagaaatcaagatactgggtggctttgaaagaagagtaatgactataaagaagcatggggggtggggctcaggggtcctggtaattttttttctctacctaaatgtgggttgcatgggtgggatcagttggtgatgattcagctgggctattcagttaaatgtactcttctctaggtatattacactttactgacaagttttttaaaaagacagaaaaaaatgtcagtggagaaaatgttgttattttatcttttaaaatactgaataaaatgttaacaatttaaatgaaaatgcatgattggattttagattaaatatatcattttgataatattctaaaataattacaaatttgtgctcaaatgaaaagcagacctctcagtgttaataaacactgtgtgtaattcagttcctcaagtagtatgggttttatcactttcttccaaaacataaaaaagtgaaacttactaagtttcatatgctgttttaatgggcaggttctctggaaaggatgtaagtacatatggtggaaataattatagatgactcacggccatcagtggaaatttacacgtcctttggaacttcaatactgagcatctgagaaattgcaaatttctactatagaaaagacgatcagaaaaaataccgttttcttttttttgccattatcattttttaactatctccttttttgtgtgttaagcatggtatctcctttttcctatttcttttccttttcttctggttcttatcttttgttagatcaatttctgattttctatggcagatagagagctggttttatttttctagactattcagtgaaaaagaattcatattcctctttatttgtgaatattgtatgaatgaggtttgaacaggtatattttgaaaatttctttttaaattaaaacacattttatacttttccacattgagatcctaaatgcctgtgggctgactgcagtcttccttaaatactatttaggaagttatataacttttgttttctttgagctcttcccaaatattccaaatttcatgcaataaaatatacttatttgtactttaaattttaaaatgaacattatttttatcaggtcttggcttgcaaaattatggtcacaggactaaggtgagaaagtaaacgtttttcctactctctctgaattttccctcaagttttttttggcagttcatggttaattggattgttcacgtagagaactttccactcattcttcttattgaggccttagcagggaacactgtataacatagcctacaatgactgatttttgagcccttcccatcaaagctttccctatgacctgccctgcccaccacctaaccaatggttagtcagcaaagaataaattctttcccccaaaactccccagttatagtcttctgaaattcctagagtcccttctgtcctcaccttaagcacattcgaaagctcattgtttagttaagaccacaaacattttagctgataaggttgtgagcaaactctattttaaacatacctcttattaaatgtttgtgattgtcactatcatcatcaatattattatgataaattgatcactatgtgccagacacttacctgtgcattttgcatgcaatatatgcatattaatgttatctaaaaattaaagccttataacaactcaatgggttatattagcctctaaactgaggctcaggaaagttaagaaatggtccaagtcgtatccatgatgaatggctgagctgtagctcaaactcagagttgactgccctttctcatgccatattatctccctaaaattatcgatataccttcactaagggccttcaaatggggaccctcctatagaaatacaaggacgtttctggcatagcccctttctctatgaggtggttagtacagcatgggagtgaagcacccaaatggggaccctcctatagaaatacaaggacatttctggtatagtccctttctctatgaggtggttagtacagcatgggagtgaagcacccacccaaagatgaaacacttgtggaggaaagaagcctaataggattggataacctgacagatagttcgaatgtcctacaaaatcaaaaatggaatgaaataccaacttacacacaaaagaaacttgaaactactcaaatggaataggctgatgtgtttttttttaaattttatttattaatttatttatttaagacagagtcttactctgttgcccaggctggagtgcgacggcacgatctaggctcactgcaacctccgcctcccaggttcaagcgattctcctgcctcagcctcctgagtagctgggattacaggcgcatgccaccaagcccggctaatttttatatttttagtagagatggggtctcaccatgttggtcaggctggtcttgaactcctgaccttgtgatctgcctgcctcggcctcccaaagtgcagccactgcgcccggccaggctgaccattttgtatgggaaagtcagcactttcgtgaatgaacacattgatcaagccactgaggaaaatgtgattcaaatcataaggaggccaggacgaaggtcacacaaagagcccctgactctaatctacaatcatgacgaagggggccccagtccagttctaggagaagcctccctgccacatcctgtgacaagtttcacaccagcagggatcttgctgagccagttaggtgggctgagtccagccctggaagatgggccatcctcgtgtccttctgaagggcactggcctgaatgccaagacctaaataaaagcagattttgaaggtttaaacgtggaataaacccaagagtgacccagaggagccagctgaagtgctaatgcaccttcacaatcaaagatatgaaagcttgtcattaattgcgcacgacagtctgaaggaggagggtggagcatcttgctggctggagaaacttctggaaaccttaagtgctctccaacttcagcatccagggtaggtgaggcaacagcaagcctactgactgtttggggtgatgggcttttttttttcctggagagatgccaatcttcagaagccctgagagcctgcagagctccatggaaggtctctggcctaggtgcccaggtgtgggtctgcctgcactgggtctctgaatgagcagggctccctcgcagttctcgtcgtgggaaccctcagaggacacggcaagaacaacgttcccctcagtctctaatggacacggactgcccttcccaggcagaacgcacgcactcgcctgcagaaaccttgagttcaccattatttattatgtctgggggatgctgccatcccctgtgatgcccctgattaatgataatgtgcaaacctgaggtaattcgctgacatgttagatctttgtgaggcaccagaatggaagcggcatttttcaaactctgctctgcgggagccccaggggctgttccagctcaggggggaaggggagggcggcagctcccgcggctgctgctccatttttagctattttatgtgtttatttgtttacaatgcttgttaggattctggatggacaaagaaaagtattgcctacaataaaagaaagaaagaaaaaacaattaaatggaatattatatgctgcaaaggaacatgccaaggggtgcttggaccattttctggaattttccagtactgaatatgcctttgtatttttggttgtgtttttttttaatatttattatatatatttttgaagacggagtctcactctgtcacccaggctagagtgcagtggcgcaatctctgctcactacaacctccacctcctaggttcaagtgattctcctgcctcagcctcccaagtagctgggattacaggcgcctgccaccacacccagctaattgttgtatttttagtagagaactggtttcaccatgttggccaggctggtcttgaactcctgacctcaggtgatccgcccgcctcagcctcccaaagtgctaggaatacaggcatgagccactacacctggcccttgcctttgttttgatgatcgtctgcattcatctgctagggctgccacaaaaacatgccactgagcaggggtttgaacagcagtcatttgttttctcatagttttggaggctctaagtccaagacgaagctatcagcagggtggttccttccaacactgtagatggcacctcctctctgtgtcctaacgtggttgtcctccgtgtgtgtctgtgttctcacttccacctcttccaatgacaccagtcatactggattagggctcatcttgatgacctcactttaccttaatcacccctttgtaggccctatgtccaaataccttatcccgaggtactgggggttgggacttcaacatgaattttggagggacatcatgcagcccataacaaaatctgacaatagttgtatatgcacattctgtaacacatagaacctgtatgatctacctgataggtgaccgctgcccaatttcagagccctcagttttggtcatatttgcgctggtgttaacaccaggctattatctaaggggtcggcatccgcagtctatcatgttggaaagcatggcagccattaggttggccgttattgtcagatggcttctcagccccctcttgatttagttactgcctatgtcactggtggattcccaataagctttgtaattaattccagtacttgcctttgtctattcaaattgtacatgcagtataaccttaaccacctctaggtccaaaatgaatgtgccactcttggtgccactctttgtgcctgcagcacattctgcttttctaattcattctgctctcctttagtttttaaaaagttaagagccgttacctagccgtagctggcaattcttgcttgcaggtaaactgagttgccatggctgctttttaggaaggtctctgcctggttggtgaacagcccctttattcccccagaacaacatggatacttctcctcaaataaatccgtgccccgtatggaccgtccgctttgccagggaaatgggtttgtagcccactgagagggctgacccatatgaccttagcaacaaaaatatgaagtgcacagctgtgtttgcaccatcagcatggccaaacaccctttctcttctcgtttctctccacacagtgatgtgcattaactggcacctggtttctgcatcacacatgcatattgggagaattgttattctagaaggggatggaatgtgacacacctcagataattgctctgagaaatgagtatgaggtctttttaaaaaaactttacatttaaacacacaaaccatttaaaaaaaccactcctccaaaacagacacacaagtgaaacaaaccaaatcgactgtccatccatttaattttgaactatctgcaatatcaccttaaagctctaagctcctaatgattttggtcattacaaatccaaaataacattatttcaaaatgaagttttactatgatttttcccatttgggaaacagtatatccaatacaacaagatgcatgtgtacctccattaaaattttaacaattaggaaaattagaatttatatatgatagattaaaatatgattatttcctaaaagttttctttagttttacgggtttgcttctggattgctttcaatagttattagtgaatttaaaatttgattcagtatgaaggtaatgtacacccatcttcttcagaacacgtattttaaaatgtgacatcatctgttctgagtctaagcactgaagaatgaagtgtccacattcaccgtatttatgcacagacacattctcattccattgacatttaagtgatgtaatgaactaaaactgccacaaagagaggagggttgggaggctgagctctggacagctctgtcactgggcaagtaacatggtgtttagaaaatctctgctcctttctgtgccattggtctatatctctgttttggacaaaaaaccaaacaccgcatgttctcactcataggtgggaattgaacaatgagaacacttgcacacaggaaggggaacatcacacaccggggcctgttgtgggatggggagaacggggaggaatagcattaggagatatacctaatgtaaatgacgagttaacgggtgcagcacaccaacatggcacatgtatacatatgtaacaaacctgcacattgtgcacatgtaccctagaacttaaagtataataaaataaaaataaaaattaagtaaagtaaaataaaatctctgctcctgtttgctgtccccactgataaaatggtagagcagatcactcctaagtcagagcttgtgtaatagctgcgtaggagtgtgaaaccaggctacttgggagccagtgctggctccagaactttccagctgcgtgtccttgggcaggtggtttacactctgttgcctcagtttctccagcaataaaataagaaaaaaatcatagccagctgatcaggttgttgtggaggattacattattaaatcttggccaagccctcggagcagactgtaaccctagtactgtctcatgcataatcagttactgatgttgttttaaaagcactgggttaaaattgctgcacctaagatctagaacctgccctaccactgcctagctgtggtggctggaggcatagagccccatagttgtggaaggaaggagtggccccaaaggcctctacctagtgaagttcacttccccctgcttccttccctaatgtggtttcttagagttgacataagcatatttctctgacacacaaacagatgactttttctgcaggattggtcagaactttagaagtaaagtgctcgagttgatgagataatttgcagctaactgcttgaagttcatgttggttatgctaaaccttagagaaagaaagctaccgtttctgaatctttaccacttatgtttttatccgctctgacacattaaagggagaaaaataccagtaaagaaatggctagagaaaatggaatatgacagctagggtctagggaggaaaaccgtgaaaatgtctgtaatgaaaagaaaattgctagacaaaaataatttgtaatttgtcttctacatgtggcattctaagactactgaatcaatattgcaagttctttgttagccataataatagtaatttttaataaatgcccaggtgaggtggctcacacttgtaatcccatcactttgggagatccaggcaggaggatccctttagtccaggagttcaagaccagcctaggcaccatggggaaaccctctctctacaaaaaatacaaagattagccatacatggtggtgcaaacctgtagttccagcttcttgggaggccgaggtgggaggatctcttgagctggggaggtcaaggctgcagtgagccaacaatcatgccactttgcacttcagcctgggtgacagagaagactttgtctcaaaaacctaataaacaaaacacttcaggtgcatgactaagagtaagcttcgtgttgggctcaaaatgctgttcagttgaaggcgctggagaagagagggcagaaagctcttggactcttggacagcctcgcagaagcaaaccttgctccaatgagggaggcaccaaatggcacaggtggctttggcaggacgttattgtaagcctgccacgtttccgtggcatacagtttaggatccaaggttctttaatattgtgtttccatagctttttcctgcaaggcagacacgtaacattaatgagctcacagcactcttggttttagtcgtagttactgaatcctcattggctgaaaagctttgtgtattaagttacacaatttttttcttttgcatccaaacttgaaataaaacataccaatttgattattttatattaattataacatgacttacgtcattgtggtttattgaggttaaaaattgatgtgctatactcagaagacagaaatgattattaagataaaagaggcccctgtaattctatgccccagagattaacattttaaacatgttggaatagatttctcctttcattttgcagtgaaaatatatgggattacattattctaaaaccgttttttccactgaacctattacagcacttttccatggactacatatgcctcattgttaaattttttagtcaaacactacatgcaaataattttaatgtcatatggttataaagaaattataacaacaaaaaactgagaatgcattccccgttttcctcccacgaagaaatcactctcattattttttaactaaatttctggtatttaatttttttcaatcttattcatgtatttattgacttcatattgtgatggttcagaaatttaggtcactttgcccatattcccatcctcccagtatgtcttacattttagttaaatctattataatcatgtaaatattaagtgtcaagccaagttgtgtgctatgattacatttttcctttttgctttaaacatctaacatttccacacttcaaagcacaaaatgattttccacatgttcaactttgtcagggaatttattctattttgtttttccagcagagacagctccaggagcccctctaccagcctccaatctgaaggggctgccaccttaagtattcttctcatgtctcccctatgctggatttcctatttcctaaatcctgtgctttcccatgtctttttttctccctcctttcagcgggacataccatccatcatttctgagaaaggatgcatgagaagaacatttttaagaacttatgtttgcaaaaagaatataagtttggaagtaatttttatcttagaaattttaaaaattgcaaagggaatgatttctccattgtcttttagctgccagggtaggggttgttatagttctgattgctgaccttcgggtgtaagttcactttcttccttttgggtgggcagtgttgaggccattctctttattcctgaagtcccgtaactttatgaaggtgtgtgtggctgtagtgtgctgggcactgagtggcatcttggaatgcaaacactcctgcccctcaatgtagggtgatttccctgtatttctttatggatgataccattcctactctttccacctttctctcccgctggaatttctactgttcaaacagacctcctggatggaggtaatttttttttaaatctttattattttgttgtacaaatctcctcctttttgacagttcagaaattttcgacttttggttcttttctttatactaactttcagaaaatatctacacttccatcttaaatacccaataatctgtttcagtttagccagagaataaaccccttaggctatcgagatgcttctggaagcagcataatgtgcagctgaatgtgcaggcggggcacgaggacgcagaatttcaggaaacccctccttgttcagcccttgccccactccaaaccccaaaacctttgaggcctccccctccccaatcctgtgtgcaatatttgctgtttttccatttactccctgacttcagattgttgagcttgagttcatggacatttcatagtaaccctgaaatattataagtctctgaaatagtgtatttctcttcctttctcttctcgctccttctcttcctcctctctctgtctctgctatgaaattaactagtttcttattacaaaccaaaaagtatctcagacaggtctcaatcgattgaggaggtgcacccaggacacaggtctgtgccttcctccaaagatgattttgagggtttggggatttaaaggagaaagggcagatattggggaaagagaaagagaattttaaatttcagtgaatctttatttttacataagataaaataaacatagggcagaggaagcaaatcagatgtgcatttgtctcagatgggcagaggaatgactgagttctgtccttcgtcccgcacctgtgaagataagctatcaatttatctcgtcagggtgaaatgcaacagaactattttagggtaaagatcttggggcccgcaaggaatttcctagtgggcaaattgtgagggagctatgtagtttttttttttttttttttttggttaatctttgtagctatcttattttggaataaaatgggaggcaagcttgcctgatatagttcccagcttgacttttcccttgggcttagtgattttggggtcccacgatttattttcccctcacataattgatgacattttagtccttattcctttacttttactatttttaaaattgcttataaaatcccaatatttgtgtattttttaatcaattcttagataagttactgcttactataaattcgtgtacattttacaatattccatattttaacaaattaccctcaaagacatatcaaattattaagtttcatttctggaaagtatgtataaaagtgttgattcttctcttacacttcctgacattaagcgttattttttaatcaattttatatacaagtcaattttatgccatcattcatacttctaaatacgtacttttagaaagctacatattcctgaaaacagaacacttattctttccacacaaaatagtcatttgaaaacttctgcagatatagacaagtaagtcataaaacatttaaatgtgtttacagagatcaagactaattattttgtagattaaatctttgtgtgcgtgtgtgtgtttaagaagattgtggggattaaatcattgtgtatatgcacagtgtttaagaagttaatgtgctggaattaagaggcaaaggcaaataaaattgtttctaaaaatttgtgacctatctttgtgtcagaaacagcttatatttaaatttgttgtttctataagtccacttaattgtcttgattgtttaaatacaggtagagtaataatgatcaaaatctgggagccctctggtggccaaaatatctttagctacagacatacatctttggcttatgttctaggttctcaagatctagttattttaaacttcttgaaagtataggcatttaaaaataatcaacagatgaacaaagtgaaataaacaagaaaaaaatgtaattgcattaggaaaacaatgtaaatttgaaaagtgatagccaggttcaactcagttcttgtaagtgtttttggaaactggcaaaaatcaaatgcatgtatttgtccgggagaagccacagtatcattggaaccttgtccactctcagcaatgcaaaagccctttgaggtggtcccatagaaatttataacatgttaccctcaatgaagtgaaggcatttaaattggaggaaaaaagaaaagaggtgtgttagctgtcttcagaggtcagaagggattctttgtcataggatcacattccttacctggacagtgcagggagaaacggaagctgaaaaaacaaaacaaaacaaacaaacagtttcaagtccatttaagaaataaattattattaaaaactatttttaaaaatggactgccttgataagcagtgagttgcccatcactgtgagtactcaagcagggagatggaaacacacttgttagaattgccatggaggggactcaggctctcaagcttgggtctaaagtacatggtctcttccagtgctgtaaccctggggctacgtggatcaacaatcaaccatcaggtaggaactgttgatggcctcagagcctgtctctttaaatcagagtttcaggaatgaaaagtgatattggcatgagaggtcttgggtctagacaggagtgaatgtcatttgtctcaagttctaggaggggtagatgtatccagctgcatgccgccttacttctgaagggataaaagcagagatggcttctgatctccagcaactccttagttgttcataagcaatgaatttagaatcacagatgggaccacacatatgtctgtgggatgctggcgtttctttctgaacaacagttccatttttattgcactccttgtgaccacatctgcatgtttcacagtctttttgagatttttgcaggcatgattccgtcacccaaaacagcaaggatatgctactcttatttctatgccttcaaaaacaaacagatctgcagatttgacaaccttgctgaaaatattttttttttttttaccaaacgtgtttataatcaaacaagttgtcagaacaaggggtcattgttgctttctcaagtatttcaagagtaagctgtaatggcatttggagagagaatataattttattctctagaacaggggtgtccagtcttttggcttccctggggaacattggaagaagaattgtcttgggccactcataaaataccctaatgatagctgatgaactaaaataaattgcaaaaatgtctcatgttttaagaaagtttacacattagtgttgggccacattcaaagccgtcctgggccgcgggtggcctgcacgccacgggtgggacatgcgtgctctaaaggaaatgagatgaatggctcgtctcattatttttaatggaacagagcttctgtagttgatctggatccatttgaacaggtgatttaacccacttgggtgcctcagtttactcatcattgaaggtaccttttcacatgcagttctatatcaaatgttcaaacagagcttttgggagacgtttaagctcagacctgaaagaagagaaagagccgctcatgataactggaataacagcattgtggggagagagaaaagcaggtgcaaaggaggccaagaagcatttcatgtgtttcgtgcagcaaaaggacaacacatcccaagccaagtagtagaaggatagattgatgagaaaggatgttgaagagacacactgatgccagatcttgcaagatcttatatgtacatgaagggaattgggatcttattttagtgcaaagacgagccacttttaagcattttaaacagacgaaaacaattttatttacatggttcaaagatggttctgggccagatgcggtggctcacacctgtaatcccagcacttcgggaggccaaggcaggcggatcatgagataaagagatcgataccatcctagccaacgtggtgaaacctcatctctactaaaaatacaaaaattagctgggcatggtgatgtgtgcctgtagtcccagctactcgggaggctgaggacagagaattgcatggatctgggaggcagaggttgcagtgagctgagattgcaccaccgtgctccagcctggcaacagagcgagactctgcttcaaaaaaaaaaaaaaaagatggttctggggagaatgaattagtgacggaacaggaacagatgcagagaatccaggtgcacttgggactgaacagggtggctctttcaaagatggaggaaagtgggtagaagtcggatatattttaaaagtgggctggacaggagtaccctgatgttgcaagtgaggaaaactgaagagtcgcaatgactcctgttttgtttttgcttggacagtgcttgtagatagaatgaaaagcaatgcctttgtgtgtatgggggttctaaagtgagggagtcatgaactgaggctcagctttgggaaccttacatttaagtgactgtgaacagtttctaccttcctctgagcctgttctctatttttccccattgtactcatcactttctaacatgctacctagtttatttatcttgtttattgtttcttgtcaatctccctgctccacctgctccctgctcctgcattgaaaggaaggtccatgtgggcagcgatttactgatttacttttattgatgttcccagaacagtcccggagcctccaaggcattcagagaacctctgtagaggtgtgaaggaagcagtcaggctgcagagttcaaaagagagacttgggagatagaaatgtgggagaaattcatatgtggatggtaaaatcatgaaaatggatatggttacctcaggaaagagtgtgcagatggttcaggaaacagctggagaatctctagttgatgtttggaggggaaggatgagatggcaaagcagaaccagcagtgggcattttatcaggtgagaggttagagggggattgtcctagaagccaagaaaagagaggaatttcagaaaaggaggtgctcaccttcagaggtgctttctagtgaagtatgaggtaaggccaacagttgcgggatgggtgtctagggatgagaagacaaatgatggagctcagggaacaagaaggatgccaaagaggctggaagcagatgttaatgatggtgcagccttctggaaccagcctctaaggagcaggggtctggacctgcacatggatgggtggtgccaatctgtgatttgaaagccagcatggggaccaaggatggaccttctctttatctggtcctgatgaaggtcaggaagagcagcagcctatgttgcaaaggatggggtgagattgggtctacagaggatgcccaagtttcagttaagacctggggaaagtggggatgatcagagcctatgctgctgatattggaggggaatttcagagaacacactggaagaactgatggaagaaggggtgattggacaaatgagcagacattcagtgcaataccgggtggtctcggtatgagcagtgaggcttgcatttctgatgctgattgagatggacagaagaatatcagggcactgggcatagttgttattggatgttcagctatgtccagctcaccacatgtgatttaaactaggcatttggggtttatttttaaagtgcattttagaaattcccagataactccttgcttgcaagccattatctagtaggtgtgcaataataatgagcttctcaatgccatcattttagtatcctaaggaagtatattacaatgctcgttattaggctgaataatatgaaattgctgttttatatgtcaaatgtggaccaatcaagcaatttcagatggttcaacctagcactccttatagcagaaagtatgtcaaagaggaaatagtagcaacaattgcagtgatacaataaatcaactcttgaaaatactttgaactatatggaataaaaataagattaacatttctattttgcaaagttgaatatcagttgacttttcagaaatgactgggggttgggaaatgactcttctcctggcccccacatttaccatgtggcacctaactctgatcaggtgctacaagtgggaattctgctctagctttcaccttagggttgcattagaatcatctagggattaagattcctgacactcaggctgtaaaccaatcaattagatcacctagggatggaacccaggtatctatacattttaattggccctgagtggtttcaatgtatcaagattgagaactattgctctaaaccagtgctttcaaactgtcatgcatatggttcacttggggatctttattgccacctcccctgcctaagcattctaattccatgggtcttgggtgcaacaaagatgtgaaaattttttaaagatctccacgtgattccaatgtgcagtaacattttggatgccttgctcagtctaaaccaagagctacattaagccagcggttctcaggcatgcatcacatcaggcttacttggaggacttgtcaaaccagagtgttagccatggctctaagatttttattccagctgccagaagatgggtccaagaatttgatttgctaacccattctcaggtgacacttctgctactggtcttggtgccacatcatgagagcctctgtaccaggctctaatagaagtactcttgggttcctgtttgtgggtggtatggctgggatctcctatattccctgcatgaaattttcttatctgaacttgcaggaaggagttccaagaggaaagacgtgggttaaaaatcccatctgctccctactgcctccttatcttcctgtggtcatttttctattcttttctgccatattcatttcctgctgctgctgctttaacaaattagcacacacctaagtggcttaagacaaagttattgtcatactattgtggatgtcagaagtccagagcgttaaatgctctcagtggtctaaaattaaggtgttggcagagctaggtccctttctgggggctctagagcagttctgcttgagtttcccagctttttgagacaacttgcagctcttgactcacaatccattagtcccttctctctgcaaagccagcaatggccattcaagtctttttcacattgcatcgccggctctgatgcttgcttccacttttaagaactcatgattaccttggacccacgtggataatccaggctaatctccctacattaaagtcagctgaggagcaaccttaactcccctttgccatgaaaccttacacattcacaggttctgcggattgggatgcaaacgtatttgtggggggattgggacattattctacctgtcacacctgcctccccccagaccccagagctggaatgcttgagtgtgaaaccagctctgcctcttagagctgggttacctggagcaggtcatttaacttctctaaactgctggaacccagggaaataaagtatctacctcacagtatttgtggcagggctacctactgtgggtaatgaatcatatgtatgtgtgccaggtcctggaaaagggattttagaaaatgttattattattgttataatgttcatcttttgcaattgtattaagagtttctgcctatagtcacacagttcctcatttcataggcaaacaccagtttctcgggtatcctttcagagctactctatgcatgtataagcatatgcaaatatataatttatttgcagaagtggtaaagtattatgcctatgtgaataatacttcattcatgttttttctttcttttaaacagctgcattgttcctattttatgaatatacttcatttacttagctagcctttattgatgaatattttgtgttcaattcttttgcaactatgaacagggctgtaactgatagtcgtataaatcaataagcttgcatatgcaccgtatatctgttgtataaattcctagaagtgagtcttctgaatcaaaggttatatacactttaaacgtgtgatagatgttgccaaatttgtctctgtatatattttatccattttcatttccatcagtactatgagaatgtgtatttccatatctctttggctgattcatgtcacccagcattattatttctgccgttctgacagttgagaataacatttcatgttttttatttgcatctctcttttgaagaaaaccagcatcttttcacacatttcttagcaatcatatttccttttcaattaactacccatttatgtccctcatccatcatgtttttgggtggttgatttttttctttaatggataattaataggatttactcacagtttaaggaaagatctattttctgtggtctaaattacaaaacattttcctactttgtttactttttgcttttgctgtaaataattattttttatgtggttaagtttctaagttgtttatggaatcataattttgtatcatactcagatctttgctatcttaggctacagaaaacaaaatttcccatatttttgtctaataataacattattttatgtttgtcatttgtatctctggaacttgtttttattttttatttttatttttttcttccaactttttaaaacatttaatgatattctattttaagttctggggtacctgtgcaggatgtgcaggtttgttacataggtaaatatgtgccatggtggtttgctgcacctatcaacccattacctaggtattaagcccagcatgcattagctatttatcctgatgctctcctttccccaatgccaccaacagtccccagtgtgtgttgttcccctccttgtgtccatgtgttctcattgttcagctcccacttataagtgagaaaatgcggtgtttggttttctgctcctgtgttagtttgctgaggataatggcttccagttccatctgtgtcccagcaaaggacatgatctcgtggaacttgtttttatttgatgaattcgataggaatgcaattttagttttttccacaagttccagttgcctcaacaccatttatccatacttgattctgtttttcctaccgattgctaccttatttattctttttttttgggtggggggcaggttttctttaaaatctggttgtttttgcatgtttactttaaaactggattactttgctggagaaaaaaatatctttcatattttgctagagttgtttgaaatatatagattaattcatgcattgctttctttaggatattgtgttcccatcttaagtagagtctgcattccgcttactcaatggtcattttgtgtagtaaagaagcatttcaacgtgctgttcatatggtttgtacacattttttatacttatgctttttgtttctattgtgcatggatcttggatctgaaagcatgcttctttgtacatacttaggcaacctatttactttttactttttactcagtcacttcactgaattatctttaccatgtctaagagtttttccattggttctcatgaactttttatttatacagttatattttgtgcaaacaatggtaatttcctttcttttttaatatgcacagttttaatttccttctcttatcgaatggtatgttctagcatttaatttcatcactatctgattcattccctgttctcatttctaattttgttttgttcttcttttcttgcttagtttaatcaacaatctaatttttatttcaaaacttttgatttatttaatagctctaacatcattctgttttcgaatgcattgattcttgtgtttatgattttattaacttgttccttttgcttttttgttcgtattttattgattttttttctagttcttttagttggatgcttatgtcatttattttcatcctttcttgttatttatatacgtatgtgtacaagacttaaaatgtctcctgagcattgcttttaacattttacctaggttctactctcatatataacttttgtatatgttctccagtcaccgttttggtttcctttgtgattcaagagtgaattcttggtcataaatcctgataagttctaactttgtggggaaatatttaatgaacttctctttgtgacctaacatgtcttcaagattggcaattttttccttgattgccgggaaggaatatgaattatctgtccttaggttacagaattaggtaaagtacaaatagatctaactatgttgtttaaatcttcattatttttgcttttgatgtttaatcaacaatctaattttttatcttaaaactttacatttacttaataggtctaacatgattctgttttcaaatgcattcattcttgtatttacgtttttattaacttgttccttttgctttcctcatgcatattttattggcttttttctagttctttcagttggatgcttatgtcatttattttcatcctttcttattatttacatatgtatgtgtacgagacttaaaatgtctcctgagcattgcttttaacatattacctaggttctacttcatatacaacttttgtaaatgttcttcgatctctggttttgtttcctttgtaattcaagagtgaattcttggtcataaatcctgataagttataactttgtggggaaatatttaatgaacttctctttgtgacctagcatgtcttcaagattggcatttttttcctcagttgctgggaaggaaggtcaattatctgtccttaggttatagaattaggtaaagtacaaatagatataactatgttgtttaaatcttcattatttttctttcgttgtatactgggtcagtcatggactgagagatgtgaattgaagtccctcactattgacatacttctgcctatttaaaaaattcttgtaggtttcactttattaaatttgatgtaatattttcatcgtgtgcacatattcatacctcttacatgtttattgctgagtatatgcttactcatcataaagggccatgctttgtcacaggaatgctttctaccctgttttaactgtgtctgctactcagaacatggccatggctttcctttccaatttgcctgatttgcctttccacattattaatatttgatatttgtaaatactttaaaacttaccacaacaatgtatagttaagtttgtggtccaaagggaggcatatgtagcacattcacattgtaaatatcatattttacgttattctttctctttatatctttattttgcattttcccctctttttctgtgtaagtgtgtgcaatatttcttttcataatatgaaaatgtgggatgtttttagtttttataatggctaactctgtaattacaaattgatataatacaggtttttttgtttgtttgtttgtttgtttgttttattttattattttttttgagacagggtctttctctgtcccccaggctggggtgccgtggtgcaactgtggctcactacagcctcaaactcccgggctcaagcaatcctcccgcttcagcctcctgagtagctgggaccacaggcatgtgccaccacacctgactaactttgtatattttggtagagatggagtttcaccatactgcccaggctggtctcgaactcctaggctcaagcaatcctcccgccttggctttccgaagtgctgaggttacaggtgtgagctaccatgcgcagccagccttcttctttttccaaatacagtgtcaacttcccactatggccagagatgaaattataaagtattctaagtatgccactccccaaattaacttggttatatttttattggtttttccagtatttatatcttgattaattgatttatcaccattaaagaatctatttgattcctgtataggcatccctctatcccttatctctcatcttctttgtcctatggacttttgttacagtaattctaaattgccatgatttacaattgatttctgtacagtaatttccacagatattttactcctaatactatagttaaatagaataaatgtggagagacaatactttgctatggttttgtgatttttcatcattttattatgaaaagtcataaatatatagaaatatgaaaataattgtattgtgagcacccattaaccattacctggattgtacaatcaatatatgcaatatttgctttacctattagctatccatttagtgacactcatcattccattgtattcacaataatttttgtattgtgtattcacaataatttttgtattattgtgaagtgtattgcacttcacaataattttcagatagcaatcgactttacctttgaacacgttagcatacatatcgttagctagagttcaatattagtggtctttcctcattttctcattagctaattttttttctgattgtcaggaagattttacagcccctgcaattcctgcctattttcccatttgaaaatgtgacctgtaatcatataattaaatgttattctgcctgggtataacattttgttttcttgagaatttcatagatgttatcccaatagtttcataagtagactgttactgtgagaaaatctgagattggtgtaattttaatttacttttttttaagtgaactctaaaaaattttttttctaattataatttatctacaaaagtccaattaatgaaatactaatttagatacagttcttgctaaatttttaatatcaactattcttagggcattgtgatcattttcatctgcatattcaagccttcttgcaatgatacttctctattatttaaaaaaattatatttaatacttttttctttttcttttcttttattattattatactttaagttttagggtacatgtgcacaatgtgcaggtttgttacatatgtatacatgtgccatgttggtgtgctgcacccattaactcgtcatttagcattaggtatattaatactttttagctcatttatgtgctgctcttccccgagcacaccagttatgcagattttgaatctccttgtcttcttccctgtctctctcccttgaatattttttcctatctatctatttatcatctatctatcatctatcaatccatcaatctatttatctatcatccatgtcgtttttttgttttgttttgtttgttttttgagagagagcctcactttgttgcccaagctggaatgcagtggggtgatttcagctcactgcaacctccacctcctggattcaaccgatactcctgcctcagcctccccagtagctgggatcacaggtgcatgccaccatgcccagctaatgtttgtatatttacagtagagacggggtttcgctatgttggccaggctggtcttgaactcctgacctcaagtgattcaccagcctcatcctcccaaagtgctgggattacaggtgtgagccaccgtgcctggcttggtttatgtttctaatgcaattcttcctcttctggacagtgtctagtttctttgggttgattacaatatggcaatcagtttttttattttttaattccctttttttctttcaagtattctgatagcttatattccatctttctctcgtctgaacttcatcttttacctctgctctgagctatttgattgcttcattcagttcttttcattcatgaccatacatttcgttcaaatgattcgtcggctcaataactactttttctggtggagcattatgttccacttgtttttccagtgcttctctgaacctggtcttacattacattgatatcaatcccatgctgggagcttcttgatctatgtctcgctttttggtggaagtcttcctagatcaggtacttgcaaaaggtttatttggagcggggaaagcataactagattagtaggagtcatcccccatttacagggaagtaccttctgatatcaggttacatttctgtgtgagttgttccacttcacttctctccagcctaccaaggtcagcaggttgtgcgcagtttgtgattctgaggacctctgcctcacccattcttgtggacgtcgagatagaatttatctggccctgcctctcctactattttatggtgccacacactcgaaaggagaggtacccatcaccaaagtcatcaccaaagtctgtgattaagccattggtagtgtttcctctctgtatatttaccctactttgagaagaatgcttctgcctgagatactgcagagaccttcttgtggcgacttctacattttcatttgatttcccttgatttgggaaggtgatttgcatgtacggaaatcacttagtttttttcaaagatgaattgtataaactctgcagctattaaacacttccccgtgtgaactctttgcccatccttcctcttcattctagaaggattcctttctgttctatatagtgcctttacattgttatattgctttttctgctttagtcatacattttttaaagtgggaaaattgggtaattgaaaattgagtgtttcagagtggtcttcacagaaaactttcacagatatggtttcatttcatccttttgacaatccttcaatttgggcattgtaatcttcatttcacagaagaacaaaagaaactcagagcacatgttatggctaaagccacatacgaacacgtgactaggctgagtttctgacaccttcattgtttcattatactgcctttcataactgggaatgaaacctgaacagtcccctgaacatggtgagagtttagacatttgatatagattagaaaaaagagaaaattgccctgattcatcatgagcagactttgccatggtgacagactgtctaattggcttatatatatctttctgtttcagtccgtaagtttgctcattaggatgtgtttttctttatcctacctaggcaggtatttggggtgtactcgtgaaccttgttcccatgttagggccctgttggagagtagaatagtttcatgtgccaggcataggcccagccaaggacatatcccctgcttcgatgtacttacacacaatggatgcctttgctgattcaagggccaaggctcttacttccttttagtcttgttagtgactaattagttcatctcctgagcttttcagttagaatacttttacaggagggcagggactgtttgtactttatataacctcagtgcttcaagcatttcaatataaatgtttcttaattgaatattatctgttcttaaaagaagagttgtagcactttgatgttctacttttgtttatctcttgtcaacagcagcaaatatttattggcattagtactaagcaatgctcagatggatggtggaattgtcatcctaaggtgttggatcaggacatgggcagtggtccccaaggatagctggaaaatcgttgagggtaattgaagctttctgggatgttttgcaaatgcaaaggaaaacatgcattttgttgttgcaggcgttttgtgcattgaggacataaagtcatttgcctgtcatagtgcagaatctgtcaggattgcagctgtcagcttgtcagtgtgacctttcctagtgtgacataccatggaattttatgtcatgctaggacaatatgacaggactgtgcattgctttttcagtagatctctccatccttatcttctcaagaaagaatacattctgaaagagataagggagtacgcttatcacatattaatcctataaagtcagaaagcagataaaaaggttatacattaagcttgattttatgcagtaattcacataagtgtgtgatattacttatgtgtgtttgcatgtatgtgtagatatacacatatatctcacacacacacacacacacacacacacacacacacacacacacacacacacaaagtctttaaaattcaggaaccagagaggcagccatgtttctgtctagcagcaggcaaagaaagactggaaatatccaaactcattttaaatgccattctgaacttaatatggaattacctaattatgtctaattcaacaactgaagcataaactactgatttcagcccaagccagaattttacagatttccctattttcctgtatagaatataacacttggcacaaatcctagatcacatcttctttgcagctattaccaaggctctatgagccttggtagagaatggtttgcatcatgcactaaaaaaaaagcaactaaatcctaacattttgagtttctttttttctattggtagggaactctcacagacgttgatatcacataacctagtagcatcctgcttgctagagcatgagtgctgtattgtatgctttatgaaatagaatatagaagtttgcttgatactatttggcaggtaatatattttatactttgtataatgctaataagttattagagtaactgttgaaactaaactttcaattgaaaaatgtttacgagcaaaacaagaattgcatacgatatcactctttaacttcttaacttcactaaatatcataaacctctttatgtcccgatgcacacgtttcctgaaccagcttgtaaaaggtgtaattgttcagaaatcagatttgaatactcagttttttatttcacaagttagattgatgcatttacagagtattttccaggatacctccaggatacctgtgtgtgtgtgtgtgtgtgtgtgtgtgtgtaatatagtgtatacatagtatgtatatactattatagatattatatagtgctctgtatctatatatagtacatatagtctgtgtatctatacagtgttctgtatttttcattggatgtatttttctccacatttaatcatcttgattttgtgtataatgggtaggaaaaattatttttgaaattctcctggttgaggggcctatcggtacttcatagtcccagggaggtaatcaattggaatctttcagcagtagcgctgactgttgagggacccttctgtcataaccagtatccacagtgaactgggaatacctccttaaacccatttatgctggaggttgcaatttttttgaatttttgcgtcagtgaaaaatcagactttgatgatgaccttgagcagtaggatataaataactcccacatgtttagtgttccaataatggaacacttgggtattgcattgatgttaataatccaaatagtttctggcgtgcacacatcctccagccaccctgaaattcgaaccctagtgatttgatttatttgtacacttctaggcagtccaccatgtgttctggaaacagttgcggctaaattactatcattgttgtgctttggcacatggatgtttgatgcaactgagaaagcaattttaatggaatttattctgacagctatatatacctggtgcagacttaatatgacatgatacgagccccacacacctaattgtgtaggattcttatgaatacatcacatggatacaaaaccaagaaacactcaattatctcatgtgtttgatgtggaaatttctttactaccccaagtctgttacctttcataaccattaaagcagccccactaatctttttataaagatttatgtttcattcaaaaagaagggatgtctaagccagtagaaagtgccatggggagctgggccataatagtaagtgctctcctttcattaaaatacctcctgttcttttttataaatgctggagactggccttctcttacattgtggccctttggagtctgaacaacttaacctcagccatcaacaggcgatccaaattccagtggggcagagcctctggatgatggggctgaatgcccagagatgacttgcaaagcatctcggaaatctttggccttcctgcccccaactccactgacgtgcatgcttatttgtaggcctgcccttgaaggacaaggcatacagattttcatccatcctggaatggtccagccaactggccagaatgcccaccaacagaacatatcttgagcaggagggtaggtgacctgcagagattcacacgtttataaaataagattgaaatcctaagatgcaaaaaagaaacaaatagtactgttcaatcgttactggaaattttacatatgcgttccttagtaagaagcttcctatacatttcttttcagagatatagtaatgtctgtcattaaaaagcagcaacaacaacaaaacttacctttgataaagtctcagtatattcaataacaatcatatgtaacatagaccctgtgagccctgatggcttagataaacttcatgcctatgaaagataaaaatctcaaacatttgcaagcaaattttatttctgaattaaaacctatgttgtaggctgtgaatatgggcaattcatcaaatgttctgaagtcattgtccatgaatcctaaatcaagggctttatccctgtaaatatttttttccaaggccatcaagcttgtgtttctgggtaaataacattttttttcattactgaaagcaaagtgctgagtttcatgtagttgtgaatgaattaataagattgtggccagaatttgaaggcaaacagtggtacatcaaaaacatgtgggatctattttcaagtgtcagccaggactagaacattttaaaaatctgtacttgacggcctcttcagcaaactaaaagtgatttgttctgctggttttcccagtatcaaagcaagcaggaatcttcagatgtattattttatgttacgttgtttggtttggtttataaaggtgctattgtgccatggtgtgaagaaaatttttttttaaatgagtaccagagtaacttgttaaccatttcctgtatagctttctaagacttttcactgcatattgacatttatgttgatgtgtatggagaaatgtcactgaacatttcattgagtttttctcctgtgtatcccaaggcagaactttcttaaaagaaacacaaaaaatcaaatgtaacatattaaattttatttctgcctttgaagaaatattttaattggcttatgtattgtggatttggccatcaactattataatgtatagaattaattaaaaataggcttaaatcaaatatattaatgtaattgtgaaaattcctatgaggtacagtatgcctaatctttattaagaaatttaagactgtttcatcaaagaaactgaagaagtttagaagtaaaaaagatatatagatgttagctcttctgattaccttggctcaatgttttcatgcttttatcttcaacaaaaactgccaccagaagaacacaggcataagtcatatgatgcagcagaactagcttttaaaataactgcttgattactgtttagaatatagcattagacaatacatcatagatgactcctgaaatcacttttttggtcacacatcaacatctgtgggaggtacaagtttattttgatttctaaaaagtgaatgtaataactggatgttttcttttcatctttcatttctgagaatacaaggatacggattagtgtcatgcatttacaatttcacattgtgggatgtacagctcttacaggtgaggaatatacttgagaaatagtcatgtatataaaaatattgtgatagaatgatgctcccccaccaaagatgcctaacatcctaattcccaaaacttgtgttatgttacattccatgggaaaagggaagtaagggtgcagctgcagttaaatgaccttgaggtagagagtttatcctctattatccaggtgggcccaaactaatcatatgcatccttaaaggcagaagacctttttcagacatagtcagagggaggcgtgactacagaagatggccggagagagtctatggtgctgaacttgaagatggggaaaagggccacaagccaagaaatttcggcagcctctgaaagctggaaaaggaataataataataattttctcttcagaggcttctgtataaatgcagtcctgcccaccttcatttagttcagtgagactcaagttcaactcctaaccaccaaaagtataagatataaataaatgtgtgttgttttaaaccactaagtttgtggcagtttgttatagcagcaacaagaaaacaaaataaatatgaacaagatttagccttttcaccctccatccagagacaaaactctcataattatatttttgaattgattttgtgagaatatactcctaaaaacaaaagaaatagattttgtttgcagcatacattaaagtactccagagaaatcagagagccagtagaagattagataaagtagatagataaatagattgatttattatgataaatattattgatttattattgatttattatagataaatagattgattattatttattaggaaggtcaagcagtcccatgatcatttccctacaagctgaaccaggaaagctggtggtgcgagtcagcctgagtctcaagatttgagaaccaggggacccagtggtataattcccagtccaagttccagtgcttgagaactggggggccactagtgtaagtcctagagtccaaatgtcagagaaccaggagctgcgatgtccattgcaggaggagacagatgttctagctcaagaagagagaatgaactcacccttcctctatgtttttgttctatttgggccttcattggattggatggtgtgtgcctacgttgctgagggccatcttgtttactcagcctactgatttaaatgctgatttcttccaaaaacatcctcgcttcacagacacatccagaattaatgtttcaccagctatctgggcatcccttagccagtcaagttgacacacacaaaatcatcacacacaataaacagactataaaacacagttgatttccatgttgacctattgagggaagttagcctttatattgaattttattcaacatgtacaagaaatgcttaattttattaggctaatattataacaactgtagaaataaatatctaattgatcaaaaatgccctttagcaaagtaaattggtcttgaagaatagagcaatcacataaaaatagaacttaaaaattccaagtaggtttgaagttgatcgatataagcatcacgctcctcctcgttatgctgctatattttgtggaacacctaccacagataagctgtctgatttaggagaaaaaaattaatgtcattcaccaccaacagaaatgtgcttattctttcaaaatgattattgttgctgaaagtacaaatgtattgtattcagagttgccataaccacagtaaggagttatgttgcatgatgaatgtgtttttttattagaaaaaccaagaaaaggaaagtttgccatagcatttcgctgtgtaaattagaatcagtctttccattgggtctggaatgtctgaaatactttttttcctaatttgagtaatgttttgtgatcataggttactcttacacactatagccttggatagaggtggttcattgttgtcaaaccataaagcacacgaacagtaatggtacccagaaaagaataaatatttcagaggtttgtgaaaaatacaataagtacattttagtttgttcgtggtctttacttatcctagaccttttacaaccaaaatgagtcatgggacttttagaaggaaattgtcagtgttaggttttgtgatggtaatgcagcaatctccaccttccatgatgcagcccatgcttgggtatgagactgtaaggagtcgagtttcattcacctacatgcccaaccttagcctgattagtaaatcctccaccctgaggaagaaatgttcattggtgggttccctacagtgacccctgtgctgctagggaagggatctcatctgcatcccacaccatctctgccagagcatgacagaataagcacagcacaggaacacaaggaggtgaccaagcgggagggcaccttggcagacaggctacctcatcagtagaggagacattggggtcttcagcatcactcaatcctgtctctatttgtgagtgtaccttgtcatctttgctgcatttggggctggccctgtcattagtatttccccaacaggactttgaaagtcatagggatttatattttcattcttaagtactatttccaataaaagacttctagatttcttagggaacatgtggttgctctactttaagttgaaaacagatatgtttatttaatggtagtcagtagaattatttcctttgaggggagagccataaacctgagttgctgagagtgattcttaaatgaaattcactttgagacttggccagagcctgttctggccattgtaaaccacacactaaacacatttgcttttttgctggttttaatattgacagaaacactgactgggaatcgctcttccttaatgcagttgatccttcacttttttgcagagggggccctgggtgcttaacggaagataaactggaaggatactgagtggggtctgaccagcaaagcactgtatgcagtaaagatttccactgacaacatccaagatgggctgacattccttgtgcccagtggccataggactggacctttccattggattacatgacatggccttagcagagtccacagttgccttgattgatgacaaagtcaagcagacaagccagcaggtcatttcagcatgcaatgaccatcagtatccattatttggactatgtaataatctttcaggaacactgtaaacagtggtattagacctaaataactaatatggttttaataaacctaaattactatttaaacttaaatagcttttaggtattcttgacatcacttcttgatgtctgtcaggtaataagttcccacgtaagaatataaagctaacgtatcctcttaaacctttgtttccaaaaccaagagcattttactgaaactctaatatacaggcaagttgatccctcattaagccatgtgttcatcttaacagatatgcacatatttttctaatacagaaaccagtttcctagactaattgaagatccttgcattgaaggtaatagagtcttattatttgcattcagtgtgaactgtaaaatccaagtcattagagaaaacaagaatatgcttctctttcaaaaaacatcaagcatgttttatatagtcttagttgcaaatttccatagttactatgtagtgaaggttttctgaaggagatgaggattcttcagagcaagggttcagttaactggcatctggaaagaaccaaccttaattctaaatcctaactggattttcagaggccattctgagggtagtagattttatctatgaccttgtgtgccagatgtttcattttatgttctcccttatttacctgaaagtgatgatgggcaagggaggcatatgaaattagctgactaatgataacacgtgatcaactacaggcttcatagctgagataccccaaagggtttaattaggatttcctgccaatctgagatttggaaagtgatttgggataacaaaacaaacacatggaaacagaatgtgatttaaagagacgactcacttaagtcaccagtctccaacagaacagaaccaatgttgcattatcccagagtgaactgagtcacctaacagcccagaggccagcacgcaattaaagcttctgaggtgctgtgatctgaatgctggtgtcaccccagaattcatatgttggaacctaatacccaatgtgataatattaagaggtagagccttttgggaagtgattaagacatgagaactccactctcatgaatgggattagtgctctcataacagatgttgaaggggctgccttgtctcttccaccatgtgaggatacagagagaaagtaccatcctggaagcacagaatatgccctcaccagacacagaatctcctggggccttattcttagattccccaggctccagaaccatattttgttatagcagcccaaatggactaaacagaaaacatagacaatgtagggcaagcgtaggtcagtgatagagaagctttgaagcaggaaggaagaatgtgggatggacagtgagtgaggcacatgtagggaatggaggtagacagcatcatccagggtacattacaaatcccaccatcatatgtaatctgccattgttcagtgtgaacagtcactgagcatcagaagaccttgatcctattcccttctctactttggagcaagttacaacatcatgggcctcagtgttctcatctaccagataagaggatcaggcccagataattgtatcagttcttattcattttgtaaatattttatgctatgccccagtttttaaaaatagaatatgtattagtcagccattactgcaataatgcagtgtaacaaatagcccctgaatctaaaagcatctctctctcttgctcatgggtgctccaggtggctggatattggctatgctcaaccggtttaggttggacttgcctccaggtaccagattggtccagattggccctacttgattctcctctcccttatgctagtaagtatgtggggttttctcttctcaggcagatcacagcagtgtcagagacaagccaagccacacaaaaacatttaaaacctctgttccagacattctgctatcacgaccttggctgccagttacatgtcggactccaaagtcaacagccctgacaagtgtacacctcataccctcagggaatggcaaacagtgggaaaaatgatagattggccacaatctagtatcctgagtctccagttttagttatgaatcctctcttgaacatgttttagaatatttcaaagttgagaaaggaaagtagcccctattaatgctggaaagacaaggagggaaagaaaagtaaaagcagcagtttttcctctattattgcaccttattccttgtcttaaggaaatccccattttgcacaagattaggttatttaagtgtttttcttcacttactttcttctaaattattggtgaaaatactaagttcacagccagaaagcttgacataaatgcctgtttgtcaactttgtaaagtggataggaatacaaatatgatgtagagctgctgtaaatctggtagaataattaaaactttaaaatatttcatttcatgtcacttgtaatcactacaactgtaggaatgatgtaaagcagagaaaataggacccatcttacatctgctagtgtttgttatgaggacattacctttcctttacttttttaaaaatttcaccagtgaaattatattgaccaaatgaaaactcatagattactaatgtgaatttactatttaaaaataatgttgaactcatattggacataacaagtgatgatataaacctagattttattttgatcatgaaataacctagtcatgaggagtaggactgtggaaacctggcttccccagcaggaacacagacgggaacacagaccaccatgaatggaatcctgtaatccatctgcagcttcaactctttaactcacaatgaagccatatgaacattctctttaattaagagatgttacagttttgtgagatacaaaatactaccgaaataaagaaggatttcaacgtctttattgacactctactgcagcataaatggatctaccaagtagggtacattatgcagatacatgcccatagcaatacaaatgttaattaaaaccttgtttaagatttctattttggaatgagttagcatttcatgctggtaaaagaaattgattaagcgaattacataaattagccaatactcagaagatccacatagccttcctgtcactaatatagatttttatcaacacgatatgatccacaggtgtgagagcaaacataacaaaggaaataactaagaaatctgtagtggtgatttctgcatctcgggaacttatcatctaatactttataacaagaacagttatactctctcctctgctattttgtatgcttttgtttcatgtccatccacacatgcatacacatgaacacatgtaccggggaagagagacaaggttcacagatgtatcctgtattatttccttcattaagggggcatgttccagttggagagtctaaacattaataaaaaattaactcggccaggcatggtggctcacgtctgtaatcccagcactttgggaggccgaggcgggcagatcatgaggtcaggagttcgggaccagcccggccaatatggtgaaaccccgtctttactgaaaatacaaaaatttgccgagcgtgatggtgtgctcccagctattcaggaggctgaggcagaagaacttcttgaacctgggaggcagaggttgcagtgagccgagatcgtgccactgcactccggcctgggtgacagagcgagacccaatctcaccaaaaaaaaaaaaaaaaacaaaaaaaaaattaggggtcttaatttgtatcatattctttttataaattattgaatacattggtagtacatgtttattattaaaaggtagcagataccttttaaatataaaaaaattaaatttaaaaatatttaaatttaaaaaactagtaaattttaaaaaataaaatcactctgatgtcaccatgctaagatggatactgtgaccattttgacctcaacatccagacttctctctacacatatgcatgtaaatgtatatataagttatatacacagatattttacatatataaacttaaacaggattgtgcagtgcctaacattttataatgtactctttgattcaacaatatatgatgaattactttctgtactaagaaacatttttagggaaactcattctttcagcaaatatgctcggtttctttcaatatacccccttggatgaagttgtaattgtttggttgtcttcataacctctaccctctggatctataatctagaagagaagataaacattagttaagtaaacaaacaagtggatttcttacaaatagtaagaaatattctgaaagcaaaataaacagtgtgcaatgaaaaagagcagtggaagaatagaagcatgaggaggaaatggagatgagttgccaacaaactcagaaatgattccatcatggggtcccatggcacaaggatcctgagcagagggcattggtcagcgagtagatgggaaaagatgcatgcacagaagcccagtgagctaagaaggaaccagagaaataagtctggggttcatccagggcttggtagggcaggtcaagggtttaaattttatcctaaagtttgagtatcttttagacaagagaaggaaatgatctatgtttggaaccagaagttcattgatgattttggcaaaaggatgcttagaagaagtaggagagaggtagccaatttgaagggtgaatggtttcataaatttatggtgagggatctgccttgttaatccttctcatattgtggaatatttagcatctattgtctttggtaccaaaacaaaactgaagagaatgatggtaaatatctatatcttggataactaagtcacaatgaataatcctgcttgttagaggcacatgacaactcacacatggtcaacgctctatgcttattcggcctccagggagctagaccaagggaaagacttacaagaagactacaggatggggttgaggggtgaatttcagggggctaaataaacaacaaggctctgtcttcttgggtcatgtcttccttggtcggctctcaagaaagatgatcctggcacttcctccttcttggaacctgggctctagggtctagatctggtctacttggcactcagagacagacactcccttttccttcatattctatgtgtttgcctcagggtttaccatttcttgtccacagactagtagaaactgaagatccaactgagtaagcttggggttgggggaaagaagggctgaataggtcccatagcctgcatccagtgcagaccccaaacttgcctgaagtccattaagagagtgtcctcaaagctccaggtggtccattctaataacattgatgataactgtattaataataggactagctaatacacactgtaagtgctgttcaatttacatatgtcaactcattccatccactcagcaacctcatgtggtataggtcctgtcatatggggtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgtcatatggggtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgccatatggggtagccctgaggctgtgttgctcagtgtcacacacagccaagactcaggcctgagcctttggactttggagcctttaacatttgtgattacccttcttctatactgtctccttccatgtgtctctctggagaactgccactaggttgaacaatgagtcagatgttcaaagggctagcatcatggatgctgatcacccaaatgctatctcaccatggccactgacatcattaatgtgcagatacatgttcctacaactcattcagaagacccaggttgctttacagtcacaaaatacttttttgtaaatactgtaaattgttgaggacattgatcctccctgatttggactgaggcacagagcattgggaaggggtccagaaggtgatatggtttggctatattcacacccaaatttcatcttgaattcccatgtgttgtgggagggacctggtgggaggtaatttaattatgggggcaggtcttttccatgctgttctcgtgatcttgtgatagtgaataagtctcatgagatctgatggttttgtaagggggtgtttccctgcacaagctctctttgcctgctgccatccatgtaagacatgacttgctcctccttgcctgccatcataactgtgagggctccccagccacgtggaactgtgagtaaattaaatctctttttcttcccagtcttgagtatgtctttatcagcattgtaaaagcagactaatacagaaggaagcattgggctttagcatggctaggcagctccaatgtgtgcatgggactcagatctcagccacttctgtctgaggttccgaatacatgcttcctaagtactcagtgctgaattctttctgttcaaacatctgaagtgttgctagtcctacctttatagaactatgtttcacttaaatctgttctacctttaacttgactttctgacttcactccagttccactgtattaataactgaacagtgggatccaggcctgatctgcactggaataacatttttgcacagggatcttttaaaagtgatttaagttctgattctgttttgcctgtgtatatgttgtggaactaatattaactaatttattgagtactatttgcaagacctatcatagctgttttgtgtctagtttctcccttaatcctcacaacagctccatgatacaggaggtaatattaatattcccattttggaaatgagtaagctaggacccagagaggttcagcaatttgcctaaatatgcacagctaatgggtggtaaacagggatgttgcttgcacctatgacaatggtgcaatagaaaagggtacttctactttatgatacctcactttcatctgctgaaaaattattgaaatatactggttttttaagaacatgccactctatggctaccttccagaaaaaaaaaattgtaaaatttataaatctaagatgtcgatattggcagtgtgcttggcatcccctagagtgtgtaggggtgaaatctgtgaatccaactccaggaaccaagctctcagcatgtatgttacagtgcctcgtgagagatgaaaggtctgctgtttttcaaaaggtgccagaagacaccctcattttggagagcaaaaataaattatctcaatcagtcctcattccttatgttgttagcatcaaaagaaagctttttctcgggccaacatggtagcttttactcagagacactgtgtgcctattaccagcaatgataggtccaacaactaaatgttgatgagaccttggaccttgaggttggccaaggccgtgctatgattgcaagattcaatttggtgccatggtttgtgaggcttacaaaagtgtataatgttcatttgctttatgtcggattattgcactttctcatttatttaactccttcacttaccactcattcattcattcatcaacccaatcattgtttgaaagcctactgtatatcaggaactgttctagacctccaagataccaagattaacataacacatgatcgttgcatctatggagtttatattctagaattgttttactttggacaatatcacaagctctattttattgagtgtgatcattaaattaggataccagatcttagggttgaaaagggtctcaaaaattatctcatctccttcattttaagctcaatgacaagtggcatcctcaaggtcacacagtctatggcagaatacagactcgatgctgtgtccccagactcctggtcctgggtctgctgctactgccagaaacttcattttaatcaggtgttggtgtcagcatacacctggtggcgagcaagaaggcagcttcaaggtcaatacagggtaggacatagggtcagactgagacctgtgaggctatgagatgaacattgctgcaagccaaatctgagagcttggcctcaagggcctgactgccagtgccccagttctggctcttcttctttttttcttttgtttttttgagactaagtttcactctttttgcccaggttggagtgcagtggcaggatctcggctcactgcaacctctgcctcccaggttccagtaattctctgcctcagcctcccgagtagctgggattacaggtgcccaccaccacgcctggctaatttttgtatttttagtagtgacggggtctcaccatgtgggccaggctggtctcgaactcccaacctcgagtgatctgcctgtcttggcctcccaaagtgcagggattacaggtgtgagccaccacccctggctggctcttcttttaaggtctgtgaacttgagtaagttatttaacctctctgttcctcaatgcctcccttgcaaaatagagataatcataaagctggtctcacagggttttcactaagattatgtaattgctcatgggaatcttcatacttctcccatggttggtgcttggtgaagcttggctattgttattactattattagtagtagtattgcctctgtgactctgtggacaccttggtggagccccgagcttagtttcttgaatcccccttgtgattcttagagtggcaattcccacagcaagtctccccttgcttgaaaatggtcctgaatgtgacccaaacagtgaacatgtcacagagcctgtctacaccccttctgaagaaagccgcctgtaggtcatccatcaaaataatcatttaatttcacattcctgattttgatccttttcaggaatcctgaaagtgaattcctaccttttcagccaaatgtaatctacttcctgtgttttcagccaccacatctgattataggtatgtggcatatctgcagtaagtgtaacacactatttcccaaaaagaggccataactcacatgcagaaccaaatccttttggaaaacagtatatgcccttcccagaaacccaaaatttacaataacttattaaacaccctggagggtactgaggtaataaaatctaaattctataaattgattgtttcagcaagaaacaggcttccaagctggcttcatgcatgcaggaactctatcatcccaaaagactgtgctcttagaaggacccagtgcttgacttaatgcgctgctgttttcgtcttgaaattcttaaccattttttaacgagggcggcctagtttcacttggcgagtccttcaagctttgtagctgttcctgacacccctcatcatatcccacagaactggtgttctgccaaacaagtctcaggtgagacccctgttgtctgttttctgtcatctgggtcaataagagacaaactcagtggagagttaagaatctatcttaattgttaaaaatatgcaccagatttcctaatctaaatgtatgtgcacacaccactagatgccagcatgaaccagagctgctgaattcctgttcagagagaattcagctcagccttgttttgagaagttctaggttcttcccccagaggactatgatggggcaacttaaacccgaaaatactgttcaagtgtaatttgtgtaaactaaccatctcagggggaaatttttccatattaatctttgtgtaatttctgaattataaaactatttttagatgaagaaatacatcactacaattgatacagagacactttaatttaattggcacaaaagtatgttaaaaatattccacagtacagatgctccctgacttatgatggggttatgtcctgataaactcatcctaaattgaaaatatcttaagctgaaaatgcatttaatatgcctaacatattgaacatcatacttagcctacctcaaacactcagaatgcccacattagcctacagttgggcaaaatcatctaacaagtccgtcttgtaaaatgtgttgaatgtctcatggttgtttttcttgattccatggctgactgggagctgtggcaccctgctgctgctcagcatcatgagagggtatcatatcacatatcgctagcctgggaaaagatcaaaattcaaagtatggtttctattgaatgggtatcacttttgcaccagtgtaaagtgcaaaaatcctaagtcaaaccatcggacaggaactgtctgtataggtaaagggataggcatagagatcagtgaaactgaatagagaacccagaaatagacccacacaaatatgctcagctgatttttgacaaaggtacaaaagcaattcaaaggagggatgatagtcttgtttccataaaacagtacaagagcaattggatatgcataggcaaagaaatgaaccttcacctaaatctcatagcttttttttttttttggtagatacagtttttaaatttgtattatttattaatttttaaactttcatttttaggttcaggggtacatgttcaggtttgttataaaggtaaacttgtgtcaccagggtttgacataaagattatacaaaaattcactcagaatggatcccaggcttaaatctgaaatgtaaaactataaaatttgttgttttgtttgctgcataataccaactaaattaaacaaacattagagaagttgaaagaatgcaaggatttaataaatcatctagcaacaaggctgcactttgagcagctgcgggctcacaggattttcctttaagccaagaggattccgcttggcagctgcggggcaaggccactggtgtgccacgccacctcacaccgcagccaccagacttcagaactggaaaagggtgattccggggtaatctctgccacctcctgcctaaggagagatcttgtccgctccctaccatttgtctatcactgatcgattccattattggaaaactttctagagcacttgttggggacaatgtaggtctttcaggataggatggcctgtctcaaaaggtcatcctagggccatgttctttcttcgtttcctacttgtcccactcaacaaacaaggctaattgtggctacctctcaaggctgtgaggaaataatcattcatagctgaaatgggtcttgtagatatcagtgattgtacattctccccaatatctggatttagtgtctaatcgggtgtttttttgtgacacatgttgtattgataatgatcaatataggtttattgagaataacaaataattacacaaattcaaaaattattttccttcattatacacagggcatatcaggactgctttttgcaattataattgaggtgctgctgcattattttgtttaattatttccacctgatggcctgattaggaaaattgctcaccttgttttcctagcataatgcaccattatgagaagcaattactgcagcctgtgtccccagcccccaggctgagctaccatcctacagtggctaccatcctgtagtgtgcatggtcttgccagcgtccagatagagtttgagttcagccatttgattctaagcctaaattcaaataatctgtttttcaagaaagggttttgtttaactctaagacactggaaaggtgatgtgtgatttctcatttgctgatgtttgacgccgttgttggcgtctccgtgttggcatgagcacactgctctctgcctccatgttgtgtgttcacacctgctctggctgtacaagctgaaagggttaaacgtatcctgtcctggtggactttgtgtggcattaatgtttgagaataagtgtgctctgccaccacgtgatcatgtgtgtgtaaacatgattaaaaggaaaatggtgatgacaaggctggtaaggaaagttgtggaactgcattaggacaggcagccatgcgagggccagaatgaaatacccagtttggaagaagaaaggcggtctagatgccccttggaagtcactggcccttcccaggtgaaaccatgtggtgtggactccagctgcctcaggtgacatcgcccaacgcaggtgatattatccacttcagatgacatcgtccacttcaggtgaaatcacctacctcatgtaacatcatctacctcaggtgacattaaccagctcaggtgatatcttctacctcagatgatgtcatcacctcaggtgacctcatccaactcaggtgacctcatccaactcaggtgacatcatctacctcaggtgacatcatccacttcaggtgatatcatctacctcaggtgacatccacctcagatgatgtcacctatttcaagtgatgtcatccacttcaggtgacattgtgcagtctcttgctagccatttccctaaactggaagagagatagaaaaaaataaatcctacctctgccatccgccaacagtgtgaacaaatccaactctctccaagcttttgttttcattccttaataattgaattataggaaaatcatcttcaaagaaaaatgcagtcccgtgcaggggttggagatggggccagtcaaagcagaaggagcccatatgaacaggcagatgttatgctttctgtgttggtcccgtgcagctggtgcctgcctgctgcaggtgctctttttttttttttttttttttagacggagtcttactctgtcacccaagctgagtgcagtggcatgatctcagctcactgcagtctccacctcccgagttcaagcaattcttctgcctcagcctcccgcgtagctgggactacctaccatgcccggctaattttttgtatttttagtagagacagggtttcaccgtgttggccaggatggtctctatcttctgacctcgtgattcacccacctcagcctctcaaagtgctgggattacaggcgtgagctaccatgcccggctcattttgacaggtatattaatgaatgaagaagaaatgtgactgattttttttgtatctgtaaattgcttataatttgaaacagatagaaaatggttacaacagaaatgttggctttcacagctgggaaagaagaacaaacgagaagcgatgggtcaacctggttaagagagtaggtttcaggctcagacttccccaggtgcaaacccagctcagctaccgtggaacctgggcacatgacttcaccctctgggcctcagtttcctcacctgtatgacagagattatctcacctaagccatataattgctttgagatttagtaagttgatgcatgtcaaaatgaagggcactgactacttttttcctttactatatctattcatagctcatcttctggcttcgttgatgaaaaggggcatctattttagggcaagataattagctgtgtcctatatgataggctgaataatgccccattcaccaaagatgttgaatccgaagcactaggaacctgtgaatgttactttacgtgggaaaaaggactttatagatgtgattaaattgaggatctttggaagtggggaggatatcctagagtgtttgagtggcatctaaaggtaaccccaagggtcctcataagacagaggctggagggccgaagtgggaggtggtggtgtgaggaaggaagtggagatctgagtgatggccaggagctgagaaacaccgcagcctctggaaggtggaagaggcaaggaacagattctccactgaagcctctggaaaaaacagccttgccaacaccttgattttagccttttgactatcagaagaagaagatatttatttatttatttatatatttattttttattattatttttgaggcagagtctcatgctgttgcccggactgaagtgcaatggcacgatctcggctcactgcaacctcctgggttcaagcaattctcctgcctcagcctcccaagtagctgaaattacaggcacccaccaccatgcctagcgaatttttttgtattttttaatagagccggggtttcactatgttggccaggctagtctcaaactcctgacctcaggtgacctgcccgccttggcctcccaaagtgctgggactacaggcataagccaccacacctggccagaagaatacatttataagagaatcagtttctattgctttaagccactaagttggtggcaatccattacaatagccacaagaaactagtacggttgactctagaaaaatgcagcagttggggtactgactgctcaggcagccagaaatctgcatataacattttactccccaaaacttcaatatagtagcctactgctgactggaagccttactgataaacagttgattgacatattttttgcattatatattttagatactgtcctcttacaataatcttgagaaatgaacacattattcagaaaatcataaggaataaaaaaatatgcttactattcattaggtggaagtggatcatcataaaggtcttcgtcttcatcatcttcacattgagtaggctgaggagtcataaaggtctccgtcttcatcgtcttcacattgagtaggctgaggagtcataaaggtctttgtcctcatcgtcttcacattgagtagttcattaggtggaagtggatcatcataaaggtctttgtccttgttttcacattgagtaggctgaggtgtcataaaggtctttgtcctcattgtcttcatattgaataggctgaggaggaggaagggggagaaggattcatctcaggaggggcagaggcagaagaaaatttgtgtatcagtgaaactgcagaaacttgggttgttcaggggccagttgtacaccccattacatgagatttcaattagtttagatggaagtttttctgaaaatctttgcataacatcagcccttttaaatgagagataatgaagatgtggcaggataactatttttgttctatttatcttcgcagagattctgtataacatagagatgctccatattctcagactgctttgcttttcgaattgctggttttcatttgtaagattttgcagttgtttttctccctctccagctgtctcagtagcggcttctctctcactgctgcctccacccttaccaccttctagttgtacagctagagaagaagaatgccggtaaagatgtgtgaagcacgtgctgtgtgttctgcctcaagtgcgtcgcacacggtatctcatttgactttcccaaaacctctgtttacagattgtgacaatgaggcccaaagaggcgaagccggcagtaaagctacacaggaggaagatagacaggagtccagcggtagagccagggccctgaaaaccactcttcactgttgtattaattggggttctctagaggacagaactaataggatagatatgtgtgtatatatataggggagtttattacgtattaacttacacaatcataggatctcacaagaggctgtctgcaagctgaggagcaaggagagccagttcgagtcccaaaactgaagagcttggagtctaatgttcgagagcaggaagcatccagccagggagaaagatgtaagctgagaggctaggccagtccttgttttcatgtttttctgcctgcttaatatttgctggcagctgattagattgtgcccaacaaattaagggtgggtctgccttccgcagcccactgcctcaaatgttaatctcctttgtcaacaccctcacagacacacccaggatcaatactttgtatccttcaatccaatcaagttgacactcagtattaaccatcacagctgtctctacatcaacttgtagaaaacattgtgttgctaaaactgtacctaaaatagcactgagctaggctgtgagtgaaggtatgaagattaattctccatcaaatgcaatgtgcagagtgctggattttagcaagaggtgacaagcagcgaccagccccctctatgtgtgtgagggtactcttcagattactggatattaggaaaaattattttttgttcatttgtattttacacaaggtcttaatgacttttaatagagttgctctgaaggctcttttcttggtcatttttaaggagatattagtaactttaattcctatgacccaaaattgcattaaggaaagaggtcatgtcttattatattttgcatctcaccatctggaatagcgcccagcatagaaaaaatccagaaagtgtttatcaaataagtaaaataagtaacatattctggagtacttaataatagccagcacttaatgagtacttactgtgtgccaggcagtaagccaggtgctgtttgtttgtattaactcatttaattctctactgacattataaggacctgaagtacaagggcgtttaacaactttccaaactacaagtggcagccctgagctgggagcccaggctatctgggtccacagttcacactttaaaacttgatgcaggctgggcttggtggctcatgcctgtaatcccagcacgttgggaggctgaggcaggtggatcacctgaggtcaggagtttgagaccagcctgaccaacatggagaaactccatctctactaaaaatacaaaaaattagccaggcgtggtggtgcatgcctataaccccagctactcgggaggctgaggcaggagaattgcttgaactcgggagacagaggttgcagtgagccgagatcacgccactgtactccagcctgggcaacaagagtgaaactctgtctccaaaaaaaaaaaagcacaaaaaacttgatacaatactgcctctctaaagtccataaatgtaacatttaaaattatattttgcaaaagacattttgcaaaaaattggaaatctgcagttgtgtttgcaatgaaaaacattattatattttgttggtgccatataataacattgaaaatttggatacaactttaagcaccatgggagagcaaagattatgtcttgttgccagttcatctcccttgcctagcaagctcagagcctcctatacagtatgtactcagtagccatgtgggggctgtcaaaagtgccatgctgcaaggggttacagtgatgcttgaaaaagtacctaaaatgcaaagttttcatacactaatgcaactttcattatattttatattcctaaatgaaaggagtcacatgaaatggtgtgtgtgtgtgtgtgtgtgtgtattaggtcgctgtatgataaaggaagtagaacgatatcatgtcagtggtcagctgggacacaacatgcctatgcccagggcagcggccagctgaaacacacagccccacgacactaaatatggatatttgctctagagggaattagtaaatttgcatatcctgtttggagatagttctgccttctcgtttagtttttgcttgtcttagactctataaaagactcataactgcagttcaacaattgataataaaatagtatttgcagcagtgtgtggtggctcacacctgtaatcccagcacttttggaggctgaggcgggtggattacctgaggttgggagttcgagaccagcctgaccaacatggagaaaccccatctctactgaaaacacaacattagctgggcatggtggtgcatgcctgtaatcccagttactctggaggctgaggcaggagaattgcttggacccgggaggcagaggttgcagtgagacgagattgcaccattgccctccagcctggacaccaagagcaaaactccatcacacacacacacacacacacacacacacacacacacacacacacacacacacacaaagtatttgccctcatggtcacacagttgaggccagcgcctttgttgggagaatgaagagtaagtaaatctcaggtaaaatattagggttaagacagatgagctttggtgttgaacatgccaagcctaaatttcagaaacttaaaggcagattccccttcatagtagatcagactggacctggactgtgaggacagacaagaaagatggagctctcccagagcgaagatgatacagtgtagcacaaagtataatgggtcaaggtctggaagaatttaggatcaaaattcagctgattaatcagtatcatttgggaaattccctttaaaaaaatggggctttctgcctcagtgctgatattcatccagaacacaatacttaactgacctcaactggatgacatcttcaatcaaagctcacaggaagacatagcagcaccaggccacatgcggcaggcagccgtgagcatagcctccctagcttgtgtctggtttggtttgatgcatcaggatgagaatctgcagcattcttccaatgacaaagccaatggggcagcttatcctctccctaactctttccctgtgtttactgtgctgtagagattttgcataaagtgctgcaaagtgggtagcaataagggagctgaggtttcattcacagagggaaggccagggattctgaatgttgactgcaggtgggcattgtgtttggcaaatctcttctacttgaggtctgaccttagccttctagactctgaaaaacgatcctgatactgacccagattggagggggtttggtaattctggttcatggtaacaaagctcccattaacctattgaacaattgagtttgtcagtatatgaatggcccatgcccagggccatggtcagctgggacacatgggttcatgccgagggccatggtcagctgggatacacgggttcatgcccaggacagtgatcagctgggacacacgggttcatgcccaggacagtgatcagctaggacagacagccccattccaatgacagtggtctggtcagctgggacagacaggtccatgaccagagcagcagtcagctgggccacctaggcccctctcctgtatgccctgctcgctgtcttcaaggctcattgcagagagtgctgtggccagaaggttgcttggtgagcctggaatcagaacactcaagcttctggtatctcagacggctgacagcatcaggtcccggggctgacacctagggagctgcttattataccccctgtaataagtattcccacaaatagggatagtacccttgcacactagatttttttttcaaagtgttagccaagtaccaatgaagaaagagcaaatgtgagccaagatgacggtttgggcttgactgaggagaatgactgtggacattgtcctgtgtgtgctgctccaaccccccagcccaaatgacaccattcccattgtcatgtttgctgtggtcactagctggtgctcctaggaagcacacaacaaagcttgctgggcctctttcctaggctccagccctttgagttatgcctctgggaaagtatcttgtacttttcttcatctctcatgtcatagtactctctagaacacttatcttttatgacattgacatctaaaaacaaaataaatagtgaaatgtggcctttgacaactttaatattgccatttacattatgaacctttaacaatttagaatgtataacgagatgacaaatttcctatttctgaaagtagtcacagatgcatagtagtatagacacatagatgccgtgaactgttcccacagcaggcaacgtccactcgtgaaaatgcccatagaccacctcgccaaattactgaatggccaatgaaaggacaaatggagagaaaaggaagcagcacaggttttccaacaaactgtccatggatcttgtaaagtgacaacatttgtgaccattgtaggcagacccatctatgcagcttctgttaactgtgacagcagtcaggctagtttaggaagtctgcctcctgcttagctagccccagggcacaagcccctgacaattgtgcctggctttgctggatacagtccagagtcggtcttttcttccagtgctaccaatggagtagtatggggccagccacaccctctgaccccaatccatgtgtgttcacaggtgcaaatttaacaatcaaacatgagatttggagaagctcttgattgaccagcaagcaaagtgaaatttactgaaaagtttagcttcattgtcctttattctgccccctacaaaaggatattatatatagatagatatccatatatacatagtttattcatgttcacatatataacatatatagttaacatgtgtatgtttatatatgtttatggatacacatgcatgtgtgtgtgtatatacatgctgaaggtggattagaaactataagattggaagtaaatatattctttagaattatactaaaacagaaaaaaagctgtatttttgtttttaagtttatgaaatgaacaaggaagagtttttttttttttttttttttggacaccgagtttcgctctttgttgctcaggctggagttcaagcgattctcctgtatcagcctcctgaacaactgggattacaggcacccgccaccacgcccagctaatttttgtatgtttttttttttaggggggggtaaaaaaattcttatttatctatttattattatactttaagttctaaggtacatgtacacaacgtgcaggtttgttacatatgtatacatgcgccaggttggtgtgctgcacccgttaactcgtcaaccaaacaccgcatgttctcactcataatttttgttatttttagtagagacggggtttcaccatgttggccaggctggtcttgaactcctgacctcaggtgatccacccaccttggcatcccaaagtgctgggattacaggcatgagccaccatgcctggccgggaagagaattttaatctcagctacatcattatcttttttgatcccagcattcctttatgtaacccaaaccttggttctgttttggagttgtagcctcaataactgtaagagattaaacttctgttgtgataatttttgtttgttttttgagatggagtttcactcttgtcacagagagtgcagtggtgcaatcttggctctctgcaacctccaccccccaggttcaagcaatccttgtgcctcagcctccagaatagctgggattacaggcacccatccccatgcccagctaatttttttgtatttttaatagagatgaggagattcaccatgttggccaagctggtctcaaactcctgaacttaagtgatctgcccaccttgtcctcccaaagtgctgggattacatgtgcgactggcctgttgtgataattttttgtggaaacccccaggaaactcacacagcttatttagattaaagataagaaagctatttccagaatataatctattcccagaatgtcatgtcctcaggcatatcgttgttgaacctttgattatattctggaaatagattttttatctttaatctgaagtaaattgtgtgagcttcctggggattccataacatatgaccacaatagaagctgattctctcacagttctggagcttacacctccaaaattcaggtgtctgcagggccatgttctccctgacagttctggagaggtccttgctcacctcctgcggcacctggcgctggctggcaagccttgctcttgttggtttgtattatagacatcacgccagtcacacggctggcttcttccagtgtttttacctcatgttccctctatgggtgtcagtgtctgtctccatatttctccattctataaggacaccacttatattgaactggcacccatcctaatggcctcatttaaatttgattatcactataaagaccttatttccaagtaaagccatgttttgagatactgcaggttaggggtctgccatgaattttggggggacgcaatttatcccatgacttctaaattagaaaataaaagaaatctgttttaaaaggtacgtcatgctgctaggctatctgcaaattaacagtgttccaaatcttggtattgatgtttgcaaaatttaaaaataggacaattcaaattttaccttcctgtttttagaaatcatatttttatattagcttatttattaaagtggaaaaccgatattagctatatataaaaagagaaaggataataggaaagtgaggaaatataaaattttgtttgtaatatttctctaaatgtttatccagcatctccctcttccccacacccctcacagcctccgctcttggatttctgcccattaagactgatagcaggaacatctatgaaatgccattcataattaattttgttacatcactgatcatggcccacatgtgttactggtggatggtatctgagttaccggcagcgaatccatatggctctatagcaacaccaattcttgcctcctcagaggaaagaattcgaccaaggggtataaggcacaaaaagagactgaggcaagtttcagagcaggagtggaagtttattttagacagctttagaacaggaaagaaagggaagtacacttggaagagactgaagcaggcaacttgaaggacaagtgcaatctttaaccttgatcctaggactttgtaggctggcccacttcaggtgtcttgcacccctttcccatgactcttcgcttaggacgagcttcccgcatgcgcagtgccctccttccccttgggaggtgagcatgcgcagtgtgtttaggaagttgtaacaccgtttacatacatgttctcaatctctctctctctcgttgtggataatgagtcagttaaaaattagtaactgtccttgttaatgaaaacctacctacattaatacaatacttctgttcaaaatattcatcgtgactcaaaattttgggaatgaatatatttgctgttaaaatgcttctagatgctcgcatatgccactgcctggcaaagtcagaagagggtacataaattacccaggcgataccttctatgccctctggacttttatgccttgttagtgtctaaggttacagaaaaaagaaatggaacactcgggttgccagggagacatccaagcctgtcaacccctctagctctaatagtgacaaatggtacttattacatcaggactaatttcattggattctgctcagataaagatacttaacctttactgataaaattgtgtcgttataattacttagtaaaagaccttattaggcaatagtattctatgtggatagacgaacattttattgaggttgattacctattacattgatggaatatttgaatgtatgattttctgcaagacctttacttcttggaaaaacctgcagcaaagagattttggttttgtggctgcctcatatggaggaagtttaaaaatgtggtttttgcaagttgttattgaaaatccagaaaaacaacatatacattttttaaaaaatagactttacatgtcaacttttttgttgttgttattgagacggagtctcactctatcacccaggctggagggcagtggcgcgatcttggctcactgcaacctccgcctcctgaattcaagcaattctcctgcctcagcctcctgagtagctggaattataggcatgcaccaccatgaccggctaatttttgtatatatatatttttttttagtagagatggagtttcactatgttggccaatttggtctcaaactcctgacctcaagtgatctgctcacctccgcctcccacagtgctggggttataggagtgagccactgtgctcggccaccaacttttaaaacaaagctttctatccaggcacataaaattaaaatatccaaatatgtcaacgaaccttttagacttttagggtatatgccctcgaaggccaagactggaaataaattacattttgaatgtcagttccatctgactggtagtgactgcctggaatgcagaactgagaaggattctgaagtcttatctgtgctcactagaaaagagtgtagtaattgattagcaatgtctgccatgggcatgagcaggacatgcatcagtggatatgctcataattgccatcccttgtctaagtttatagaaagatagcagttgtgtcaatgaggcattcagtttaaaagagccttttctgtctcctccatatgcattacatgctcagagcctcctcattctcagtttgtcttaggcagggaaaccacagccctataggacatttctcaaggttggctctgtagacctcttctaagcaccctcccctgcagggcacctgggaaaagaaatgtcctctcccaaggagctatttgtttcaacactgtcagagagaaagtcatggagatatttgtcttaaaatccaagtactttttgtttcctttgtccattttggtttccgcctctcaggtgttaattctgctaaaatggtgattgataatactgttgtttatctctcctgagagccaaagatatgccccttgatggcggaaattcaaagactgtgagaggcagtaaaagaaaggctctgggacagggttatttttcaacatacacctcaaaacacacagcgctggcagctcctatgagagcacatgtatttgatatccaaatttttctagcctagtgtcccacaccaatcccacaagcacaaatgtaattcttcaaaaaggagcatgctaagaagtgccctgaagtttgcagaatgaactcatgcagcactttctgagcaggctgggttccccttgcctatgactatgcttaccgaaggtcaggcttccctttgacaagacaggacaggtactgtatgcttagtttctctcctctgtctcaccagtttcggaggcgtgttcaggttctaacgtcaggggtgaggtgaatccaggtgaggaatggtggagtgaaggatgcagtgatgggcctgagctgcaggcagtggtgataccagctcctctccatggctctcaagtcttgaacacacatcaattcctctgtctttcttcatggctgaaacaattgtcaggttaacatattatggtaaatataggtgagaaggtgacacttttaagactatgcctgaggctgttgctcccaggcactctccttattaagcttctatattagtttaatattagtttagtatgctgggtctgccatcacaaagcacacacagtgagtggcttacagcgaaagaaatgcatcatctcccagttttggaggctggaagtctgagatcaaggtatcagcagggttcttccttctgaggactctgagagagaatctgttccattccttgatcgtagcttctggtcgtttgctggtaatctttggcattttgttggcttgtagaaacatcatctgatatctgccttcagggtcacatggcattcttgtatgtccgtttgtgtccaaattccccctttgtataaagataccaggcatattggattagtgctcactctaatgacctcattcagctaatttcatctgcaaggacagtattctcaaataagttcacattctgagatactggtggtaggacatgaacatacaaattttggggaaacagaattcaacccataacaccatagatacttggttcaaaccaactctcctgaatcctgaccttcctgcttgctccataaagtttgacttgattccctcagttttcctcaggatttcagtggcttccaccttttgaaaacaaaagctgattttctgaattataaataccaggcattctgattttagcaaatgtagaggcttttgatacggataaagaaaagataaacgaaatccagaacccaagtcatagatcttgagtcatacactcaagcgcagattcatgtcaaactgtttccttttagtctttcacatatatctatagacttactttaaaaatgaaaattggcattgtttatatataatttctcaccgggcttattttaccagtgttacattgtgattatctcatcaaattattcaatattcttgaaaatatgagttttcttgagctacaaagctatcacaattggtatcctgttactgtattttgctttgtgcctaatttttttgttttattatattatcagtcccttaatatgtcattttcataaccactttttctctaatgactcaaaagcattccttcagtatttgttctaatgattactcttaaattttatatatacttatccaaacttttttataggtgtaaaagccaagaataaaaaagtatctatgggtttcttgggtataaagtgggtaattttatataattttaattttttattctttctagtcagttccttgttccaataacaataatgtgagactttatacatggtgatgatgatgctgacaatgatagaattgattttaggtttcatgaccatatcatatcttttgacataatttatgtttagctgagattaagttatgcaatacattcttgagttcttttgataggctagaagatgtatctgagtaatttttcccagaaattatatgtgagtggtatagctggtgagaccttgaatctgggtgaatctctttctttgccctcatatatgaaagataagatggctgggtatagaagtttgctcagagaggtgcatattctgttccattgaccttggatgatgaaacccagtgttttcatgtataaattacctgttttaccagcctgcacagttagaaaactttctttacccctatatttcaaaattctttgatatatgtttcagaattatttctcttttaaataatatttcggatacttcatgaatttttctatctgaaaacacaggattttatgaactcttgaatacatttaaaaaatattttctgggctgggtgtggtggctcacgcctgtaatcccagcactttgggaggctgaggcaggcggattatgaggtcaggagatggagaccatcctggctaacacagtgaaaccccatctctactaaaactacaaaaaaaaaaaaaaaagctagccgggtatggtggcgggcacctgtagtcccagctactctggaggctgaagcaggagaatggcgtgaacccgggaggcagagtttgcagtgggccgagatcgcaccactgcactccagcctgggtgacaaagcgagactccatctcaaaatagatatatatttttttctttaattatttccttttctgtgtcctgaattcctggaatttttggaaaaaaataggttgaatattcatgtccagttcataggtttttaaattgttctatcaggggttttttttctctaaatttttgtgaaacatttatagtttgtatttgtattttaccccactaattcaattttatgcattattctactgttttcagtccttaattcatttatcatgttttttcatatctatccagtttattcacatcctagcctatcccctcattttagcagattgttctagtttcacatacaaaattcctttttggtttatgttgtgataattaattagatgttttctaaaacactaatttttactgtttgctaaacaatcttacttttgcccttcagtaccggcaatcctgagcaaaagaaggcttgctttgattgccagtaaaacccatgttcttgtggccataatcttcacctcacataacctaaacaccctccttggaatattacaaaattctcccgttcccagctgcagaactatatgaattggatttacagatatcatagtttttttcagcatccacatctttaacttgaatttcaattaaaacttattggttggtcaaaacttaaactcttagaagattttttgctcagataccatgtcaaagtttagaggacgttcactgaatcctttcctctggccagccttactttcctgtcttcccacccagacagttttccagaatctgagcattgaaatctcctgccaaacacaatggataacactgaatctcaatgctttcaatggatggcattgaaatctcctgccgaacacaactgatactctggcttcatgttcatgaaggttctttacacccctctaatcccctatcgtacttcaatggttacttccaaggaagttctccaatctgccttttgttgaggaacttttgcatagaagaaagggcaggtgtatccacgcactaggtctaggtttgaggctgccttaaagttactgagggcaaggggcttcataatttggagcctcaccttccccgtttatacatgaggatcatgatagtggacaggcatttttcttagaaataaatgagataatttgtataaacaactttttttttgtattttgttattgtgatcctttcttcatgtctattatgtcaagtgatgtacttatgtgaaagggattttttaatttttcttgtgattaatattaactaagcacaacgattataatttgctaagttaaactgaattaaattgctttatatatctagaaccagaccggaaatatctgggtggttattatagctaaattccatactatagcaataagataaaatatgagttatttactgtctaatatggacatatacatggctctgtatatctatttttcttcatcaaatatcaaatgcaatattacacattagacacaacaattaacttgtgttcatgtttctgaaattgattctaatgtattttctattgtactcagaaatttaccatcaatttgcaagatctttataatgattatttaaagattaccttatttcttcacctttattgtcttgaaaaatggtttctgctcaaaaagaattaaatctgtaaatgacgagttaatgggtgcagcacaccaacatggcacatgtatacatatgtaacaaacctgcacattgtgcacatgtaccctaaaactttaagtataataataataaaattaaatctgtatgaaatattatatattggcaataaaaaatgaaaataaatgagataaaaatagatgttcacgcaaccttaacaactttacaatgctattaaaggaaaattttaggaaatttcctattcagttgggagttgtcatattggaaatgcaaatatggacgtcagagttacagatatagtcagatgcctcaaccaaatcagaccaatgtcaccttttcagatgacaaaatttgaaggagcattgcacgttccagagtcccttgattttcacctgtaatgatagctagttacatgagatgttcttgaattttgaaattataaagcatttttggggggcatgaaatgttcatgaaagaatgagattttaaattttatttacatttctgtttttatctttctaaaaaaatcctaaattaattctgaaatcatcttgctctataatccaaccactagagagtagtataatacctctcctagacatatcattcatgaaattttattaaagtttttattataggatccttattttcttttagtttaataattctatcaactcaattgaagtttatatcaatccctacaatttttttttgcaaatagctcacttttttccccaaattgctgaaactacaaacctgtcatttttcattttgctcttgctttgtcttgaaatacagtgactattcttgtctccaaactctttgtctgcttattttggcaaaatgacaacatttacacaagagatggcaagaggaatgtccattttctttattagataacttcaacaagcatccattaagcaccaaaaacttaccaggcacagagtgcaaccaagggtatttctacaaataattacgaggcttttccttcctttattgataaaacacgcagacagatgaagacataatctgtgtgtgagcacagtgggtcaagcgatcagtacaaataagggtaacggagttcagaaaggggagaaaccaatgcaggatgggctgtcagaaaaatgccacaaagaaatagaggagtgggcaggagcagagccttgaaggacaggtatgaagcagagcgttaaatcaaatgtgtccaatccagaaaaaggggatcccctcatgtccagccaaggcaggacttttcacatcatgtccaagtgtgcaggtcattttattgaaaaaaatatatttgcacagaaaaactgatgaagtctagattgcaaataacctcttttgcctattttggaagtttgaagtaatcctgtgtgcctgtagttcccaacctttttttctgcctaaaaatagaaaatctgagctataaaacctatgtgtcattaataaaaatggataatgatgacagcgatgcatgacatgatggtgccgtcctgagagttgggggaaggtgtgtatagggattgcggcaggggttgggagagtttagagaggggaagcagtgtataaggatgagaagaccctcgaagagggtcccaccggccccctggggagcctgtgcaaatggtgcctcacagcaattaccttgccagggtgtgagatctcccttagagggatagaggcatttgtgcagttctgcagatcagatttctccagggccagggcaacttccctgtccaggcctaggccagttcttttgtcctttcaggattctagatttctcttccagtattatcacaatgtctcctaagcaactgtgctccttgaaaacatttggtctcactcctcagcatcttgcacagtgaccatccagacctgggtcattcattagtttgtctacctcatattcatttctctttgaaatacatctataactcagtatattagctctgtttgttgtttgaacagtctaacagtggtgccaccaacttttggcacgctctgttaaagagactgtagatgacagtgcccttttatattccgccatgttgcactgctattttgtcctagaaattgagccagttaaattccatctgtcttttctttttttataactatataaaatcatgtatcctacatttaaatataaatacagagctttgttagaaaaaatcaggctcgtttgatgataatctttaatttgatatcaagaaatacattctattgagtacctaacatgtgaaaaacgtccaaatcaaattccaggtctttttttctcaggctttttcttcctttgtttccatggaatcacaccttctttctgtagctttgatcctggaaaatgttgtaggcatatattataaatcctgctatatgtaactttggatatattttattgagggtaagaaaattgtctcttggttacttgtgaatatctatatgctgaataaagctgagatgaataaatagctcttccttcctttgtcccatgtcttgataaattatctttttagcttttagacctgatgacttaccttgtgctttatcagaacactttgttgccttaggcaggttcatgtcggcaggtaatgactcactcgagatattctctgcactttgataataataatctgtgatttttgagacatacctatatagctaactggatcaatgtatttcacactgcaggttgcactcattgttaggatctgaaatacatttaatattgtaaggccaacattaaagaaaaagaaagagaaaaatagggactaagcaatatcaaaatgtacctcatggaaaaagtgtaaattattcattaatattttgcattcccacaagtaatagttgaaaagtttagttgtctcagttcttcacagtacgttttaattttagctattctaggaggtatgcgttggtatctcattgtggttttactttacatttccctgaaaatgatattaaacatttaaaatatgctaattgactgttcatatatctcctttcactaagtatctgttcaaatattttgcacattgtaaatggcaaagaagacttttgttttcttatagtcgagttctaagaactcttatatgtgctagataccggtcccttatcatatatatgttttgtaaatattttctcttaatctgcagttggactttttattttcttaaacgtatttttggaagagcaatggttttcagctgtgatgtaacttgttttataaatattttttcttttatagctcaaattatttttgtcccatataaaacatctttgcttagcctaaggtcacttccgttttcttaaatgttttcttccagaaatattacagtttcagctcttacatttaggtctatgagctacttcaagttaagttctgtatatggtttgaagcaataattgaggtccattttggccatacagatttcttagttttttttcccctatgtatgttcacatattccagcactactttttgaattttttctttctccattgaattacctgtgcacatttgttgaaaaccaattaactctatctgtgtgggtctgttttcagaatctaatcagctccttaggtccctatgtttatctttgtgtgaataatatactgtcttgattaggtaactctataatgagtcttaaaaccaagtagtctaaatcctttcactttgttcttattcaaagttgtttcagtcatcctgtatctttggaatttccttgcagactttataattagtttgtcaatatcctgctgggatgatgattgggattgcattgaatcaagagaaataggagaaattggcaaaaacaaaggggctacaggccccatgtaagtcccaaatccagtagggcagtcaaatcttaaagctccaaaatgatctcctttgactccatgtcttgcatctgggtcatgctgatgcaagaggtgggttcccatggtctgggcagctctgcctctgtggctttgcagggtatagcctccctcctggctccattcatgggctggtgttgagtgtctgcagcttttccagatgcatgatgcaagttgtcagtggatctacctttctggggtctggaggacagtggcccccttcttttggctctactaggtggtgccccagtaggtactctgtgtggggactctgaccccacatttcccttctgcactgccgtagcagaggttctccatgagggccctgcccctgcagcaaacttctgcctgggcatccaggcatttccatacatgttttaaaatctaggtggaggttcccaaatctcaattcttgacttctgtgcactcgcagggtcaacaccatgtggaagctgccaagacttgaggcttgtaccctctgaagccacagcctgagctctatgttggtccctttcagccacagctggagcagctgagatgcagggccccaaggccctaggctgcacacagagaccttgggcttggcccatgaaaccactttttccttcaggtctgtgatgggaggggctacagaggtctctgacatgccctggagacattttccccattgtcttggggattaacatttggctcctagttacttattcaaatttctgcagcaaactggatttttcctcagaatatattttcttttccatcgcatggtgatgttacaaattttcccaaccttaatgctctgttccccttttaaaactgaatgcctttaacagcaccctagtcacatcttgaatgctttgctgcttagaaattccttccaccagataccctaaatcatatctgtcaagttcaaagttccacagatctctagggcaggggcaaaatgccatcagtctctttgttaaaacataacaagagtcacctttgctccagttcccaacaagttcctcatctccatctgagaccacctcagcctgggtttcattgtccatataattatcagcatttttgttaaagccattcaactaggctctagggagttccaaactttcccatattttcctgtcttcttctgagccctccaaactgttcccagcctcttcttgttacccagttgcaaagtcacttccacattttcaggtatcttttcatcagcaccccactggactgtaccaatttacggtattcgtccattttcatgccgctgataaagacatacccaagactgggcaatttacaaaagcaagaggtttaactggacctacagttccacatggctgggggagcctcaaaatcatggcagaggcaaggaagagcaagtcacatcttagatggatggcagcaggcaaagagagaatgaatgccaaatgaaacgggtttccccttatcaaaccatcagatcttgtgagacttattcactaccacaagaacaggaaagcgaaagacccaactccataacccaaacaactcccaccaggtccttcccacaacacatgggaattatgggagctacaagatgagatttgggtggggacacagagccaaaccatattagtgagtattggtagtttgtggttttatgagaaactagtctaaggtgtttaatttgtatgtgtagaattgcccatattattctcttattattctaatatctggaagatcttcagtggcatctcgtatttcattacttatattggtaatgtgtgtcttctctcattttcacttcttcagtctttctgtttatcactttgatatctatttcacatcaatggttttagctattataacttatgttgagtagtgtttatgtgagattttttgtttgccttattttttatatctttttgctttaacctttctatgacttaacttaaagtatgtttcttttacacagcatatgattaggtcttgcattttatacaatctgataatatttgctttttagttgaaatacttgcagtatcaaaattcagtgtgattattgacaatgttgggtttcagtcttgctatttgttttctgcttatcctatctatcctttgttctatctttccccctttcttgccttcttttggattaagtccatatttcattgtattaattgtataaaacattattttgtctccattcgtggcttattctgcccctcttttgttgttattgtttgcttgtttgttttcccctacaattcagtgtgtgtgtgtgtgtgtgtgtgtgtgtgtgtgtgtgtgtgtgtgtgtatataattactgtctatcttcaagtaatattgagtctggtcacatatattgttgaatcttattacagtgtatttccaatactcccctgctagacttgctactatttttgtgtgtattttatttctacatatgatgtaaacttcacaaaatatggttaattatcttttaaatggttaattatcttttaaagatattttaaaactgataataaaaggtgttacatttaaccacatattttctgactctcatgctcctcacttgtttacatcggttgaattttttctgatgttcttttctttctgccagaaaggctcctgtgagcagtttagtgcaggtctgtgggcaatgacttctttctactttggttagttttagcaagactcaactttacttacttttttgaattttttttttttgtactgtatagagaattctatatcaacagtttttctttgaaaactttacaagtgtcaccccattgtctctggtttgcatggcaaaatcttgtctttcttgtcttcatttgttcgtaatttaaccctggcccctttagatatttttttcttcatgactggctttcagcagtttgataatgatgcatctcggtgttgttttcttcatatgtccttggcttaatattaacggtacttattgcatctgtggctttatagtttcatcaactttggaactatttatttcaatactcccttcaaatattttttctgttctatctcttctttcctctgataggagtcctaactctgcctcccctaagtctctaattgcacatattctatactgcttgatattacacttcaagtcattgatgctttgttcatttttatctggttctttttctatccgtatttcattttgtgtagtttctattgttgtttatgagttcacagatgatttcttctgcattgcccaacttcctattaatcccaaccaatgataatttttcatttcagatattaaatttcttatcttctaaagtcttacttgggtttaatttttatattctatttccatttatactatcctttttctgccttcttgaaaatggcacatatttatgatccgtgttttaatttccttgcctgttaattttatcatctgtttcatttctttattttttggactgttaaaatggatttatttttctccatatatataattttgctttatataatatatacatatttctgctttagacatgttttgtaattgtttagtggatgtcagccattttgaattttatgttttgggtgctggattttttagttttctttcaatattgttggacagtttactgggatgcagttgagttacttggcctcaatatgattccatcaagccttgctttaagccttgtttgcacagttcttgtttgcatggttccagtctagaactgattggctcccttactaaggtaatattaatacaattctgtggtttctacttgatttctcaaatattcagacatactttcactgacttgcagggatacaaactattcccacctctgtatgagctccagtgattcttgttcttgccgtagccttggctaatcttcccacatgcattatcagaataactcaataaaagacaggggtgggccctctgtaaaactcaggatctgtccacctctcactaggattcctctagtactttttcctacattctagctctgtggcctcttcagcgttgaaactgtgctctcaactcagagaagagaccatcaggctggttgggtcatctctggaaaagcagagatttcactttgttcgctttccttatttcaggcttccctgcatgttttccaaatttataaatcactatttcatatattttgaccatgactcaagttgcataagataaaagggaaaatagggactttcttaatcaaggctgaatgtggaagtgattatagtgtaatgtaacatttaaaaatacaaattacattctaatggaactttttaatgccatagctctcaatactcagaagctaaaggtattgccagtatttactgtacagtttttatgactatgtatttgggagcagttttgaaaatacacccttaggtatttaaattattctttaggcttaatggttttctttctttgtaagcattaatattgaactataattgttatccaaataaatatttagtgatttctcagagaaaaagataaccacacattacctaaacacctggataggtcagatgataatattctagttccattcataacatactaaaaatggactatttggagattgctacctattagagaataaatgtctcatttatcggaatcacactagcctacgaactctagttatgtcatttaaaattatgactggcatcatggggcacacagtgactgcactgcacatgtgagtgaacacgtcactccagctgtgtgtcagacaggggtactgcatcatccctcctgtaggaatgagtgggctcggggaaggaaaatggagggcacatcaacagacaaaaacaaagcctactgaatatccataaatgatgtaactaaatcttaggatagaagaaacctacaagaaccaatgccaacttacgactgatgaatgtctgttgctgtgtcagaaataaaagatattcaattttcaggttgtcaatgctcctcactaaatgtgttccccaaactgaatgtgatgcccagatgatctcgtagggcaatttccagcaaatgtctcataaccagcatgtcccttcacattgtttgtcaatagcctttcaagcccttaaagctcaacatttccagaatgtatggtttcccattctaatgataatctattttaataagttaccttaaattccagcttttcagtgtcctgtccccccaccctatcacagaccttccaacttagtaaccattctttctttctcatcatccacgtcatcaatgaaaattgtcaatgctaaccctgaattatttaggcttagtgtacttcattctttatttaatatattctttgttttcatgttgggcaccgagatgacccagggcttagataattctgtgcctccttgtagcaacacaaacctattttcaggcaaagatgggtaatatcttctgttgttaaaacacagtgaacacagttctgtagtgctgtgtaaacccaccaggtagccagcgagccttataaagagctaagttcctttgatgggctccttgaaagataaggaaccatcaagatattcctctggatctggttcacacccagaagggttataaccagttattaagagatgcataacaaatcacccagaaagttattactcaagataaacatcattgtacagcttatattaataagtttttgggacaggaagcagagcagggttctggagggcagcttgtccctgcttcacatgctgtcacctggactgggtctgaagaatcaaaagtggcctcccacctgtctagaacctcagctgagacagcccaaatgagtgggcttgcagacctctggagcctcgctactcttccacatgacccttgtctttatatggagtgtctcatcctccagggtctcccctccatgtgacctccctctttatattaggaagtttggattccttcttatgtctgctgggttccacctgagcaaaattagaagcttgaaagacctccaaagggtcaccttgaatctcccaggacattacctgcattgctttctattggtcaaagcaagtcacaaagccatcccagatttaaggggcaggaagagtccctacccttgaatctgggagttaaggcaaagttgtctcacaaatgggttgttgacatggagaggactgatttattggagaccttctctttttaaaatttagttttagtggacacataaaaattgtatatacttatgttgcacaacatgctgttctgaaatatatatacaatgtggaaatgtacacaatttattctaactgagctaaattagataaagctaattaaaatatatattactgcagactcattttttgtggtgtgaacatttaaaacctatgcttataatgattttcaggtatacaatacattgctattaactatagttgctatgttgtacaatatatttcttgaatttattccacctgtttaactgaaagtttatattctttagctcgtatctctccaatccctccacctgtcagccccaggtaaccaccattctactctctgcttttatgagttcaagtttttagattctacctatgaggctgggtgcggtggctcacatatgtaatcccagaattctgggaggtcgaggcaggtggatcactcgaggtcaggagttccagaccagcctggccaacacggtgaaaccctgtctctactaaaatttaacaacaacaagaagaagaacaaaaaacacaaaaattagcatgtatggtggcacacacctatagtctcatctacctgggaggctgaggtgggagaatcacttgaacctgagaggtggaggttgcagtgagccgagattgtgccactgcactccagcctgggtgacatagccagaccctgtctcaaaaacaaacaaacaaacaaaaacgttttacatatgagtgagatcatgtggtatttgtctttccgtgcctggcttgtttcacttagcgtaatgtccttcaggtttatccatgttgtttcaaatggcacgatttcattgcttttttaaggctgagttgtatttcatggtttatacatattttctttattcattaatgctttggtggacacaggttgattctgtatcttggctattgtgaataatgctgcagtgaatatgggagtgtagctgtctcttcaaatattgatatcatttcctttggataaataccaactagtgggactgctggatcatatggtagttctatttttagttttttgaggagcttccataccattttccatagtgactgtcctagcttatgttctccaccaacagttcataggggttcccttttctctacattctcaccaactcttgttttctttcatcttattgaaaatagtcattataacaggtatgaggtgatacgttattgcggttttaaattgcacttccctgatgatcagcaatgttgagcattttatcatataccccttggccatttatatatcatctttctttgttgttgttgagacagagtctcactctgttgcacaggctggagtgcagtggtgcaatctcggctcgctgcaactgctccctcccaggatcaagcgattctcatgccttgccctcttgagtaactgggattacaggtgcacgccaccacacccagctaaattttgtatttttagtagagacggggtttcgctgtgttagccaggctggtcttgaactcctgacctcaagtgatccacctgccttggcctttcaaaatgctgggattacaggcatgagccactgtgcccggctatatatcatcttttataaaacaagtattcaagtccagtccccattttttaattagattatttgctttcttgttattgtattgagtctcttatgtattttggatattatcagatatatgatttgcaaatatttcctttcattttgtaggttgtctcttcatgctgttggttatttcctttgctgtgcagaagctttttagtttgatatcatccatttcactatgttccctttattgcctgtgcttttcgggtcaaatacacaaaaattatttgcccagaccaatgccatgtggcttttctactggggaccacttttagcatatatcactaatgcttacccccaaaattgcaccagtggatataatgctaggtcttgataaattgctcaactcctaagtgcatgcatagatattatatacacaaggtctcagagggataatatggtaagatggctgctctgatcccagtttaatgcatgaaagaccctgttacattttcccagggtctacctctgctcagtgctttcagaacataagcatcactcagtatgaaaattattatttttactagacaatatacgccactagattctcagttcctgggggccatgggctatgtcccattcacctttgcatctcccatacttcatggcttctgttatacgggagccagctgcccagttgaaaaaccaaaatagctcaacttgaataatacatattttgtactgaagcaaattaaaagccttgctgtaaccacactaaattatttcatatgtctctgagatcctagaatctattgcctaggtctgttactgggtgtgcctgctgacctcatgaatatcagtcattttaggaaagatgatccatccattgaatcaaaatggaaatgaatttgaagcaaacagtgccaggagtgcaaactgaggagactttcctagaggatgacagcacagtgagctccagtcaaggagggaccacgccttcctccactcactattctatatccaacccctggcctggagcctggtgtatgacaagccctatgtgttaaatggagtgttggcaatgatagaactttccggagaggatatctaaaagtggaattattccctgtgtttatttaagtgcaattcaaagagcaggtttttcagagacacacaggaggagcctggaaaatctgtgacgtgttaagggacttgtgctgtattaaagaaacaccaggtttccaaggaaacccttttagccttgtgcttaatgtttgctcttctgccctcaagaggcccagtgaacacacaattgtttataactagtcaagagactggatcttaggaaatcacttgcaaaattgtccaaaattcctctaaaatctttgatctaagagatctccaaccgcctcttggttcacagaatctgaaacagtatcttaactgtttcactttgctatttatgtacatttccagaacattttgcaaatgtaaagtgcctcgtagcagcattttgtttgtaccatagatgaatccctttgaagttaacctttattgaggcaattgttaaatgcagtatcatgaacttgtgttcacagaagacaggaaaagtgtaagctataggtctgaaataagagagaaataagagagtcagcaagggacacagcagtccatctcagggctttctcatttatgttaaaaagggaattaacatagataatctatgtcagtttcttggcacaatgctgaacaggtagttcagtaagttgtagccatgatggtgatcatgatgatgatgaatgatttggaaacagacatgcctgattttcatattattttctaagatattttcttcatcaaatgttctgaacacttaaaacttaactgctgtatgcttgtcacaggcacattcaatactcaagctttattaatgagcataatgtcctcatcagccattcaagtctagggccttctatcacattttaggctcaactatcttcttttgtgattttgtcattggtagcctcatggtgaaatttatggctctacagagagaagggcatgtgtattgtgtgtgtgtgtgtgtgtgtgtgtgtgtgtgtgcacatgcatgcttgcatacatgtatgtaagcatgtgtgttgatgacaatgattagcctgccaaaccacccatgtaagaaatcggctgtataaggcatagtttgttaaaccacaagtctgattttaaggtttccaaagaaaattccactgggcattgtctttaatttattctttgtaaaatagatttactctgtagtcccagctacatgggatactgaggtgggaggatcacttgagcccaggaggcagaggttgcaatgagctgagattgcatcactgcactccagcctgggtgacagagtgagaccttgtctcaaaaaaaaaaaaaaagatttactaatcacctggacattaaaaaattgttcttttaaaatgtacattctccattaaagtatgctagttcattgataccttttcctttttaatatttcaagggatcactggaaatatatagtgatgcttttaataattatgtcctttctaatcattccacatcattgagcgtgttaagcacacatgatgtcagctttggtgcttgatagaaatgatacaaggttggcatgttattggaagtgcctgctttcagtgtctagtgaaggatattgggaaatagttaaatgagccagaatagggaattactatgaattatggggtgggggggtataatcttgcttccaaattttctcaattgtgttaattcattttttcctgtacttgtctctcttaagtaatacaaagaaataatttattgatagctattgccttactctgagttttgatatgtcattaaaattaagccttaaaactttgtattttgaaaggtcaaaaaatggttagtataatgagaacctgacttcctaaacctaaaattaaaatgtatctcagaatcaattgaatttttccttcaagaaattgttgttaaatcttcctctcaataaattaaaaaaaaaaaaacaaataaaaaagacaatgtcaattttgagttaagtgccattttttttaatcctgtttatctacaaggagccacagtctgcctaactttaggtaaagaaaagcagtatcacttggaaatatatagatagtttactccccgtggaaaaaatcattatttctccatttagaaataatttcacatttaagatctctagaactttactttttccctaggcagatacttgttctaatgatctgagaggtaaaaactcttagcttagcttcttcttaggaatctaataccatttgtcttaaaaataatatattttagccgggcgtggtggctcgagcctgtaatcccaccactttgggaggctgagacgggcagatcacgaggtcaggagactgagaccatcctggctaacacagtgaaaccccgtctctactaaaaatacaaaaaaaaattagccgggcgtggtggcgggcgcctgtagtctgtagtcccagctactcgggaggctgaggcaggagaatgacgtgaacccaggaggcggagcttgcagtgagccgaggtggcaccactgtactccagcccgggcgacagagcgagactctgtctcaaaaaaaaaaaaaaaaaaaaaaaaaaaaggaataagaataataagaataaattttacttgaccatttagaaatcataaatgttccctgtcaaccacacggggaacttaaaagggggaaacatttgattattgtccagtgttgctctgctcagttgggtgtaaaatatagctagcaaggctgggccgacttctggagaaagaggaaggagagctggcaagacgggcccatggcaggtctccaggtcagcagcctccagaggggaacatggggcccctttggaaggccctggcttgggctgggctttgtgctgttctcttgaccctggtgggaacatggctgtaagaataccatccctgtctactctccttatatcctttgtaacatatgattatcccatctgcagcacattttaaatcacaatgccaaagtgcaacagtcctcaaggagtggtccctgcacgcttgatggtctccaagaccctttagggatttgcaaggtcaaaactactttcaagataatattgagatatcattcactttctttgttgttttgacatctgcaatggtggataaaattgctggtgtctcagcaggtgtcaaggctgcgggatccaattatacttgttttgtgtaaatagtgtactatattcttcactgctacacactaacagaaaaaaaaatccaattttattgagaatatcctttatgcagccatataattattagttttattttatctcaacccttgagtatatgactttttaatagcctctgtgaggaaacaggaaatgtattcccataaagtgtggttattttgaggaaaagcatttgagtggttgagctgcaagctgaaataatccttttcttaatagaactttaaaaaagttacttttcctgttactgttacttttacttagcggaacaagggacagaaaactatggtaatttggactacagatgacagttattttctcaaagtatgaaccaaggtgatcctgttacttcaaggaaaataaccaacagtatttgattcaatggtaaaatttttcaaacaaaaattcaaattgtggaaaaactgtatccaccattatgtacttgacagcctcccaatatttaaagaacttttgtgatgagatcagtgattatattaacaaatatgattttttagtgttatatattgaaacctgtcaacatttgaaagatctgcataactcagtgaactataaatgactaatgcatgatgttacaaaagtcatgcattagtaatagatccatttaaagctcaagatagggcaatcaattttaacataacagagtatgaaaataccattccaactaacctttaagaaattaccccagaaggccaggcacagcggctcatgcctgtaatcccaaagctttgggaggccaaggcagaaggattgcttgaggctaggagttcaaaaccagcctaagcaacatagcaagaccttgtctctacaacaaaagtttttaaattagctgggtgctcatgccactgccttccagcctaggcaagaaacccagaccctgtctaaaaagaaagaaagaaaaaaaacttacctcagtagaatattcacaattacttacaaagactattaaaacactcctttattttccatctacatatctctgtaaagcctgaatgcagatgcagatatgagaattgagcattctattagggtagacgttaaaaagatttatgaaaatataaacaatattactcttctagctatttttttgttttggaaaatacaatgttttcattaaaatatttttaaataatgtaatggggttactatttcatttttaaaataaatacatattttaaaatcttttaagatttctaccacactaaatataaatagctacaaatcacataatgaaacctctttatggtctccaataatttggaaaagtgtaaaggggccctgagacctgctgcacgggaggaaggtgctcccggaacagggagaaaggttgagtctggggaatgctgaccatgacacctgcttcaaacacagattccctgtggctgtttttcctctaggattctgttaaaaatcctgttgaagaatccattccacatatgggtaaaatttagaaatatgttccctggaactgggaaatccagggacaggagaaaaaagcagcaacattgctttgttactttgttttacttgctacatcagacaaaaaacaaaaaggaatggatataattattttacgtacctcttaagggcagtgtgaggtttatgtgagtcaacgtttataatgcacttaaggcatacttgtcactactaagtttatataaattcttgttaaataaaaatgaatgaatgaatgaataagcagcttctaacagaaaccgtggcagcattttttgctgagcacattgctaggcagtaactaaattaatatgatgcttgacctcagagatttaggaagttggtccaatctaggcacatgcagagaagatacgtttagaattctgaattttgatggatattatctcaaatatctttctgaaacacagcgaaatataaagacttttataaaatcagatagcatgcacacaggaattgacaatccaggctctccagtttaagtaggtggatttcctaaagaactctaaagatatttaggaactagaagtgactcagcttccaatatagaaacccttttccacccatactctcaaaatcaatgtgaaatagctatttgtagatggaatctttggactcctatgttttgttttgttttgttttgttttgttttgttttgttttgtgagacagggtcttcctctgtcacccaggctgaagtgcagtggcacagtcatagctctctgcagccttgacctcccagtttcaagcagtcttcctgcctcagcctcccaagtagctgagaccacaggcatgtgccatcacacccagctaagttttctatttttgtagagtcaaggtctggctatgttgctcaggctggtctcaaacttgtaggctcaagctacttgcctgccttagcctactaaaatgctgggattacatgtgtaagtgactgcacctggtctggaccccaatttggctgaatcattcattcctcaagcaacaagtacttacatgggagatacaaagaaaacaatattgcctcttcttagaaagaaactcctaggctgggtgcggtggctgacacctgtaatcccagcattttgggaggcagaggtgggcagatcccgtccctactaaaaatacaaaaattagctgggtgtggtggcacacacctgtagtcccagctacttgggaggttgaggcagtagaatcgcttgaacccaggaggtggaggttgcagtgaactgagatcatgccactgcactccagcctggcggcagagtgagactccatctcaaaaaaaaaaaaaaaagaaagaaaaaagaaaggaaagaaacttctaatttcacagtggagatttcagtgtgtatgcataattccaaagttagcggagcagacagagcaagggtgttgggactgtagagccctagaggctaattttaagtccagctccaatcattttgtatctgtgtgacagcaagcaagttatttattattttaaacatgggatagggaattgggggtattttgacattttaggaagaggaaatgaatggtgtgagtgagcacaggggagaaaactgcaaggtctgttgggaaccatttggagtcaactgcaaaagggatccgggctgtaggttaggatctgggacaaggtcatgtttaaggggaccttgaacttcaggatgctcagaataactgaggaaccattaacattgggtcacttcttaaaatgtctgaatcaaagtgacatgtcccctaagagtgtataagtgcccagagcatgaagattccgtagtttgtagacaggcccaggaccagggaatttaggtaagttttttcagcaatagccagcagaatccaaacatccttaatgaggtactgtgtgcagcacagcctcctaaactacaagcttactctcaaaagtgtaagttgacaaggagtaatgctccgggtgctcttagagtagtggtagaactagtggcagtagtggtggtggtggtaattgttgcagtagtaatggtggtggtaataatggtatagcaataatagtaaaagtagtggcagtagaagtactggtagtggtagtagtggtggtggtagtattagtggtagtagtgatgatagtaggggtggtagcagtattggtaatagtagtagcatagtagtggtggtagtattagtgatagtagcagtagtggtaatagtggtagtagtagtaccgccaatagtaatagtggtagcagcagtggtaacagtagtattggtagtgttgccaaaacactaggggttcagtctaggtcctactgctcgccacatgaatgccaatcactgagtgttttaggctgttcttgaattgctataaagaaatacctgagactgggtaatttagaaagaaaagaggtttaattggctcacagttctgtaggctgtacgggaagcatggcattgggcatctgctcagcttctgggaggcctcaggaagcttctcatcatggtggaaggcaaagggggaacaggcatgtcacacggtgaaagcaggagcaagggagagagtgagagggagttgccacacacttttaaatgacaagatctcgtgtgaactcagagcaagagcacactcgtcaccaaggagatggccgaagcccttcatgagggagtgaccctcatgatccaatcacctcccaccaggccccacctccaacacgggatcacatctcaacatgagatttggcagggacacagattcaaactatatcactgagacaatgattattgccagtgaagaagactattctggtgctgcagccaaggagatagaagatcagtctcaaatccatctctcagattgattaaaattggggtttttataggatgaaagcaatgtaaccatgtgtgggaaaacaggaattagggaagggtaaggaaaaggagtttgtcaataggaagcaggtggtcagttaggcaatcatgataggtgagggtctggtacctcactgtctagatgtggtgatctgggaagtttcagttctttgatgttatctgggaggccctcatggttagtttcctaagaaaaggacttagataagacaaatgtaattttgtcaagttgtaagactgggagggtcaatttctatgtttattcaaaagaaactataaacattaattctataggacagttgggccagcatcagttgtagtagctgtggtagatggtggtagtggtagtagttgtggtaggagtggtggtagtagtagtagtagtagtagcagcagtggcagtagtaggggtaataacggtagtagtagtggtagcagtgttttaggggcctgcattctccagtattttcctcacagaccagtggccacaaccatttccagttaagtgttccgttcctggtgggcacccagctcaggaacactgcacgtgtgtactgtgagttgccccccatctgaaatattcttcacctgctcaccctccattactgagctgaaacttccacaacaaaccaacagcctccttgtgttgggaaaccgttcccattacagtagatattaacgagccctaaatccaatctaactgaatttggctaattcctaaagttaggattttctcagaagttggcgtgatggtgaagaatcccttttctctggtacccgttatggttgacaatcagtgaagttttcttgtgcaattgcatggcatttaaacattattttagcatatttttgtgaactaaatatactattttggaatttgaatttatcttttggtgagacatagtagcaaggaagaggaagtaaacaaaatctctctagtgaattaaaatataaaatggtaaatgtcatctcgatttaggaaccctgtcggcggttcagaagcaaaatgagctgccctgagttggagcctccatgggacccgcttccgtaggcacaggcataaagtcagctttctgttgctgaaggcttggaagaggctgcaggagaacactgtaatcagatttgacattccgaactgatggctgatgggctgtgagggccgtggcagggagtgatttcaggggctttaataaggcttggcaaataaatgatcaggtcacactgtcactgtgtgaatgccaatgtctttctccccaatccattccctgagaggactccagggccaaatagaaaataaatttaaaatgaactgtgaacactaaaaaatctttaatagactttgtccatggaaagtgattcttttttataaaattgctttaatgcccattttctttgtgttcatgaatataaagagaaaacaaaaccaatagcaaggtctcagtatttctgatttttttttaagttttgtgatttaagaaaaaaaaagaaatcaaagatacattccttgcgaaggcaactatggaatctacacccaaatctccaaattatattcataagtcaattgtaactaattttagtattcctaaaagaatgaatttacaaattgctctcaacccttttagcctaaaatataggaaaatgttacagtctccaggtaggaaaaaaaacatgcgtcattttacagctggataccaaagagactcaaatttttgatctaaaagaaaaaaaaaaatacagaaggaaagtaaaaatagacctgacctttgaaggcagaaatttcttgtctttaaatttgactttcattttctttcattaaaataaaaataaaataaaataaagaatgccccctaatagtctcttctcaagttaaaaatactgcaccacatcaaattatttttggaaccagccaagagaggaaagggaggaagaagttaaaatacaatgctatcatttcttattgaagttagaattttcataacaatcttgccaatgtttttcgtcaattacactgactgaacacagtatatttgtatcaaacgacattgtttgaccactcaaattaaccatgtaaaaattacctaattctacctttacttccttataaattttccttagagttcccttgggaaatatttaacatacagtaaagatcctgggattaaagttttaaacccctctgccatctaagactgtctgtatttctatcctaatctctcttagtactccccaattacacacaaaggatccaagtctgaactggtatgccttcggttctacagttctcagtgttgaaaatctccctctcccctgtcttccaggtgatattcatccattatccaaaacctcagcccaagatcaaggctccctctagggaaaagatagcttggccctgctaggaagaattttctcactcttctgtaaatacttctgtgcagggtttgtgtggctcaatattgcatttccacttctttctggtttacctgccttggttgaagactcagggaagcaaaaagctgcattcccagacatagctgccagggctctggaagcggttaaaacgcagtcagatgcattgtgtatgtatggagacttgagagactctgacagcctgttgagtgcaggttcatattctattatttttcatcctgactgtataaaagccatctggtctgatgtggaagaaagaatgtggcattgggagtcaggcaagcctagattgtatgaccttggtcctcaacctatgcaatcttgctgaaactcagacctctcattcaactaataaaaagggttaggggaattaaatgaagtaatatgaaaaatgcctggactgtagtaagcaataaagatcattgttcttatctttatctcgcctcatcttcatattctaggtgaagtagataagtgtgaattcactgctgtatttagacccccacaagattgtcattgcattaaaccacccaacaactgccttgactattccatgaatttatcagtttgatgtctttctttaagaaaaagtatagatttgaccacagaaactttccttgagagaactgtattaaagaaataattagaaatgcagaaaaatatctatttggaaacttattttaattataatggtgaaatattagaaacactcaagaacagataggctaatccaattattatatacccatccaatggattattacacagtattaaaatgatgtattaaagcattcaaatgacaggtagccactcataatttagcaacattcatacaatattcattgagcacatgaatctcataaaaggatcaaataaaataagctgaatggaaagctatttaaataacagtttaatctcaattatctaaatactatatatatgtagaaaaaagcatagacggatatatgcaaacatgttaataatggtcagctctggtgttcagctgttcatccttggtaatggaattatgtgggatttatattttattctttctagtttttatttttcagatttttcacactgtgcctatacttgtagtcagaaaaaaatgtaagttaaagttttataaaatgataatatggatttcctattaccttgattttaaaaaaatatgcctataaaaacatatacatttagtaaagtggctttctagaattttcgttgtattttctcctccaaagcacaagctcacaaaagggctgggaacatgtcttttcatgtttaaatcttaatgaagactcatccatgtattccctgttcgtggagctgttatggattgagtgctgctccgcatcagaggtcatgcacgtggatctggagattcctggatgatgaaggggaaggtgccagagcctttgggtatggctttgaagtgggagagactgagaaatcattacctttctttggcagtatacctttaagtctgcactctttagatttgagggcattctaaatctttcatccaagaagactttgtggtctcaatttggagccgatattagggaaccagcctttggagctgcgtgcattaaatatgggcttacacttgatgtcaaggaagcaaaatttgcctgatatctaacatgcactaataattctgtacatgtgtatcagctcattgatctttttagtacttgatttgggggttgaattgtaaattttattatatcttttgaatgtgttaaaatttttttcatgattaacagttgaccttgtggcttcctaaggagctctggccaagctgtgtcatgctttgaaaaatttcactgagttgtggacattgcttctgaggttatattcactgtactactgctctttggtcctttatgggaagcatctcttcaatagcatcttgcagagcttggcaggacctgggggaaatgctcgtgtttgggagtagacccagaggcttcaccgttctgtacgtggtggcttctttcccttctgcgtctgagatacataacacattccccatcctggaattccaattccagtgttacaagaacttgtgttctacccttctttctgacctcgaaggatacttacaataaattcatgtgattattactttctacgtcgtgttggttagtttcttaggaaatcgttgaaaatatatgctttacaggagtaccattttctaatccactctcatcctataactatttaaaaaatacatatcattttaggaagagtgtggcctatagatgaacctctgatctgactatttgaggcttgttttattgctcttagatttttccaaatatttatcaaacactgtttatctttaacccacactagaataatacatgattattattcttaatacctgtacataaatatcacttataggcattaatttttatagtactaataggtttgcatgttcaggaagtactgaggattaaaataaaggaattcctctcatttacccaatatttgaatatgagatttaagatgtgtgttggatgccagacgaggatatgtagaataaccatggagataatgaaggaaataagaaatgacttttgaaaagactggtcaaggcaactaccttatgaagactcagcctcaggtgggtatttcaccggcgtggttcccacagcccgaactccatgctctttttcacatctgcttcccccttggagaggtgctttctctctgggaagaaagaaggggctagccaaacttcctggcgtgtgagatgacccagagtcacattctaatgcctagtctgtgcaaattgtgtcaacataccatactcaaaatgagatttttgtagttagcaatcttctaatttttgcaacgagaaatttccgataacagcaatgtggtaatacacttctctaaatatttgcagtgagcaagtatgtattgagtgaacatacctgatgctatgtgggacactgtaggagaaatcatcatgcaccagtggggagacatcctgtcactgacactgctcaagcttacgctaacctgtagaaaaactccacagtatgaacaaccctggagagaaggataaatcatagtatgaaactgataaaattttaaaaagtccccttccaaagaaagaaacattgaaatgctctatggttgtattaaattactttcaagcacattgtatcatttgatcaaactaagttgatggttctctaatcttctcaatctgcattctttgcacgtaatttacattaactatagcactcttatttcaaacagcaggtgggtagactgtgtaaaatttagcctccctccagatttctatatgtttgtgtttatgcactcagcgatttttaagcgtaaaattggcttcttatttaaagccaaagtgagtgaatagaatactcattgctgctcattctaacagccatgagtccagcccctggtaaggcaatagctctcacctgtctttgtgaatattatttatattgcagcatttgctggtatggttggaccttcagggattgtttaaggagcacaatgatttcatgcggtctgcatcatccaatatgaaatgttatataccttgaaatatttttccatagtgagaaggtctccctccactccctacacttgcaaagaaccatagatacagttttctttcttttattttaagcttgttgctacctgaggtaggcaaggaatgagctgctttgagatgttataatagattcaattgtgtcccctcaaatgatattgaagctctaatgcgccagtggctcagaatgtgaccttatttggaaatagggtcattgaagatataagtagttaagatgaagttgtattggagtaggatgggcccttaatccaacatgactggtgtttttgtaagaagagggaaaacttaaacacagagagaacatggccatgtgaagatagaggtggagattggaattacgctgccataatccagggtcattgaggcctaccagaagctgggagagagaagggaagatcttcccttgaggcattggagtaggtacggacctgccaataatactgctggcctccagaaatggaaaagaataccctgctatcatttaaaccacccggtttgcagtactttgttgcagcagccctgggaaaataatgtggatgccacatcagaaggtgaagccaagagcacagcacggaatagggtgcatcagcaatcagctaacccaaggctatccaccttctctccatgaattattcaggtcttatttttgtacctgtcagtttttaaagggagattgtcatctcttgattggctattacggatccatctaaaatggttgctgtctaacagctgactgatagactccacactttttacccctgtgcagtgaagaagagtcaaaagaacaaaaatgtagtttttgattgaatactaagatcagactcatccacctgctgagcaggtctgaataccactgcacatgcaactgggcaagcatagtcaaaggaggcttgattaagcaaaacgaagctgagacagctccagcctctcccttgccccaccctgtccatgcgtgcagctccccctccaggagatttgaaagggacagggtggggtggtgggggaatggatagacacaggatgagcaggtgaccaaggaggcttattctcaatgatgcctgatgagaagaaacacccagacttgtagctctgaccacacaatacgtcctcttaggatacattctttctcatttattccccgtgtcctcacgtccacacctgttctctcacttttgcatccttcccaaatctgtgttcttaagttttctcttccttgatgcatgaacacgtggcatggccattgggtaggaagcaatgcaggcaaacaagtcggccagtgtacatgaagatttctcgagagtacttgtccattctgcgatggtaacaggctatatcttctttcaaagacaagagtttagggtgtggtttatcactcttttcattaacctgagtcagataaatccagattctgatgtactttatgttttagatggtaagctctttgtcaacttggttcatatggttaaaatgatttggagaatttaacaaataatttaatcaatatacctggacagtattaatgataaaaatcctattatggtaattcagcatagattttctataatctattgtggtactggccaaatacagtggatatctttggaatgtgccagaaagaagtggtgcccactaatcagatgtcttttttagaacattagctgttttttaacggtcctcttttttgttatttctcttcataaaatattggctatttaaaagaatattctctaattaaaatttaatgtcaggaaatgaaagaaagatggtttcaatgctagacatttataatgacttttgatttccttgctcaaatgacaagtgaagttttctcagcatgacatgagaataatttatcagaagatataaaaatgagcaaaatgtacattggagaaaacccttttgtactctcaagaagagagcaaattatcttaaaacacgggggatttctattcatcttttatgcaggaatatcctacttttattaaatacatgttgaattacattgagggaaagagtaaacttaccatattgtatcccacccatttctaaatggcacagggtagttacactgtacactacatttactgtaagaattgctaagaaaagccaacatgaaatgagcatgttctacctggaatttataaacaattactaagtgggaaaatgtggggagaaaatacagggaatgaaattaaaaagcaagatttgcttacccagagtggtgaatttataccaccctactccaatagggtatgtgcatttgaatggattgtaataggttttagtaggattgaacacactttccagaatgtgaagtttgcagtgcttagagttgtatcaaatattttcaaagaacacagctggtttatcagtggaggagggggggtttaaaatggccttaactcccgtgattttcctatgaagattaaatagagtaatgaccatgacagccttatggaaactgtaaagagcaaggtctggtttctcaaacagtaaagagatgcctgccaggttaagatgtgggtgaaatggaatttgtggaaaagtgtcaaaagcactaaagagattgcttttcttcacccacaaatacagcacgctgacctacctcataccgagaaacacaggacttcatgataccatctgctgtgatctccctcccatctgaaatgcaattgtcttccagtgttctagaggcatctaactttttatatcaatcatatttgccattattatcactttatacagtcattatttgtttagggttactcacgcatacctcgttctttctccacccttctttttgcatctcattattgagtacaatttcttttctggaagcacatcctttagttccaggcgcaagcctgctattggcaaactgtcggttcttatcaatactgggaaatttccaaattgttttcccaaatattgcttttctgccatttttttctaccctctccttgaactgtggatttcctctatctctccttcaagtctcttaacctttctttcatatgtatctttctttcttccatatgtttctttttctctctaggaaatattctgagtaatttctgtagatttattttcttgttcactaatttttcccaactgtgtctaatataaatatttatgtcaagggttatgtgttttatttctgcccattctgcaaatattttattgtttatctaatatttgtatcttttatgatatactcttattcacttatcctatttttaattcaattctatagttttgcaacatttaaaatacttattgtgtaaacattgtcgagttatttcattgtctgaggcctctattgcttcttctgactcctttttatgataaattgttctctaatgtgttagaggtttggtactggaagctcaagattggaagggaggagtcaagcttcatctgtaaacatttctcagtgctccttcctccagggaagatttatttgtctttgcttctgccagatgtccttagaagcgaagtcactatatgttattttctagagtgaggtctactggaccctggagacagtgagactacaaatcccaaaccagagcaaggccagtactatggttagacataatccctacacaaagcttaggctaggaaggcaagggtatttgcaaaggctgtttttttttttttggaggtccaatcttttagtgaagttgtacttttctgcagacttctcttgtgtaggacttgtgtaggactaacagccttccatttcctcattgctgttaaaactatgttttttccccctaaatgtgcaaatgtcacagggaaattataggtagtatcaacaagatctttgctgttaggtattcaccccccctcttcctttatagagcccagagggctttccttacctgagaaacctgctgttcatttaagtcaatgttagatttatgcagcttgtctaagtttcttatacctggagagttttcaaaataattagttttttacatagtcagaaatggaagttgctacaactcactgctgattcactgactatattaaactacctgaaaaaaaaatggaaaaataaggttccaaataatgtaatctgacatacatttcatgagagaaatgaccaaaacttaatcctagagggaattttatcttaaaatcctagagggaattttatctaaagaaaattcattagatggttgtaaagcaaaaatgaaattaaaaaataatataaataaacgtggagttcaagaaaaacgtcactgtttccacttttaagtggagaagtaatttgacaaattttcattgaaagaattttgctgatcacgagtttctatcaaaacccaagaagtgtaaacataggaagtgcttataggttaataaagcaaaaatcatgtgttattaacgaggaagtgttaaggtggtgccagatccacgggcactcactatttcatttctgggagcgtttttcagcctgcagttcccacaccacgcgtgccgtggagctctctgtgccacgctgcggggcctcggtctgaccagcagggggcaccgagtgttctcccgcagcggcccggcgtgggcggcggctccaaggccgattcctcagcaccaggcaggtgcctttgaagcaaagggcgttcattcacattcacaaaggtctccggaacagccttgtaggttcttcaactgccctcaactaaagcttcggaatctgaaaacctgggaagaagcttagtgtcctgacagtattttccttttaattttgcaaagtttacaaaatccattaagaattgctttgcaatgaaaaatatacacatttttatactttttgttttcaagtgcttcattccatttatatttagcggtgaggcgggcctaggcaaaaatgaaataaaagcacagtgttaagatctgcaaggccattaaattgcagtgcacgtaattaatggaccatgatattgcttaaacacaaatgtacactaatcttgatccagcggtactagtgatttgttgttacagggctagatccacctaaagctcatggtgaacacttacaaccttgcacagaaagtgactgtgcttgaaagcacgaaggcaaaatcccattggccaaagataccttgtattcctagctgtgaatcggtttatcctctttattttatactttgcattattttattacttggaagaattcacccacttttttctgacaaaggcttatcagatttttcttcttaaaaaaatatatataaagttttgaagaaaagacaaagcattgcaaagagctgtcagagggggacgagaagcttacaaagtgagcaggtggcacacagcctgtctgcagtggtcatgtgagagccaaacccctcagccacattaacagcctacagcatgtgccaagcccttaagaagtcacatagcatttcagagaatcccacaaaaccaaaaacacaaattctgtcaatgcaatacatatatttctaggtagacgtattagtacgtctcttatgtgggtgccgaggaatcttgtaaaagtttgtgcaaaattgacgtcagttttactgcttgtcagcagtgaaatgagtggattcattgattcattcatttgacaaacatttaatgaaccactactctgtatgtgttctagggactgggaatacagcattgaacaaaatacagaactaaatgcatgcttgatggagcttttattgccatggttagcatgagttacattcataaaatatactttattttcattaaaaagaatgagctagatttctttatatcaacatagagagatcttaaggaaacataacgttggatgggaaaagtgagtttttccatgagaaatagtaaaatacttatgtaagtttgaaaaacaaagagaaaatacagaaccatactatgtgaagttcattgtcacagctatgtgtgggagtgtgtgtgtaataaaataaaaagtcgaaactgggaatacacactaatatttctgataatagggttttttaggagaaaaatataggatggggagggaacaaagagaaaaataaagcattttctgtaaagttttatttatttcattaaaaataaataaagcaaattacaccaaatgttaacaatgatcaattttaagaaatgggtacatggatgagtatgtcatgcctatgtgggtgattggtactttttcagttaaataaataaatggcagttggaggagggacagagaaggacatggggagtgagaccaaacaaggatcatgatgagaccagaacttccctagaggagtggcccgttgtgagcctgagagatcccctgtagcgacactgagcagagctccctgtgcctctttccgtcctggcctcacgctgtctggttggctttcccgatccgtcgtccatctctgttgtcctgttgttgttgttgtggttttgagatggggtttcgctcttgttgcccaggctggagagcaatggtgcgatctcagctcaccgcaacctccacctcccaaattcaagcaattctcctgcctcagcctcccgagtagctgggattacaggcatgggccaccatgcctggctaactttgtatttttagtagagatggggtttcaccatgttggtcaggctagtctctaactcctgacctctgatgatccacccacctaggcctcccaaagtgctgggattacagctgtgagccaccacgccaggccttctgctgtccagttttagtaacagctttagcaactgccttgctctgctctcagcattctctgttttaaccatcccgatttcacctctgcctcccttatgtctaccttttgtctcacagtctgacaatgaaaatcatctgccactatcctagcaccaacctgtgggcctccctgaactcccacttacctgggccacgtcagccctgcagcccacggagctcctccagggggtgcctctcctgtgtttccttggctgtgatctccaagcagagggcaggccaactgcgtgtttcctagtccccctaagtagcttcatctttccctcctagcagtagacccctatccctttctctaagaaacactgtataacccacctcttccaggaagcatcgtgaacacagtacttctcaaatctttgtcattcatgaactatctttatgatatctgcaatcattgaatgccatctgtgctagtgtttttgtcctttgaataattcttgtttacttaaaacaatgtaattataaaaaaatgcattactacttttaaatggaaaatcagtttaactagccatacagataaatgcaatacaatgaaagaaaaacaataatattaaattctagtcagatacaattgccttccaaagactctaaaccagcggtttacttttcctttgtctaaaaaaaaagaaaagaaagaaaaaggagactaagaagtgttagagcaatagtgaagataacttacttctgcaaaaacgtgctgagaattctagtggaggcacctaagtcagtgagtggataactggtaccttctgtggctttccctttgaaagaatcacaagaattgagatttacagaggagaaaaagtctcaccatgtgtccggatatcatttctctatagcgtcttatcagctgcataccatcagtgggttccactccattttaattcatcatggatatatcattttcttttcttttcttttctttttttctttttttagagggagtcttgctgtgtcacccaggctggagtgcagtagtggcatgatctcagctcactgcagcctctgcctcccgggttccagcatttctcctgcctcagcctcctgggtagctgggattccaggcgcacaccaccacgcccggctaatttttgtatttttagtagagacgggttttgccacgttggccaggctggtgtcgaattcctggccttaggtgatctgcctgcctcagcctcccaaagtgctgggattacaggcatgagtgacctgcccagccagatatatcatttccaatctctctttacatcagcgcttacgtatatccaactgacactgtttgcctctgttttgcaattgtttgcacttttactttatggtatgtttcctttccttctcattaggaattagccttttaggtaacttggattccattactaggtctgcatatgatgggcagttgctacatgattttattaataccattttgttacaaaggttattgcaaggcaatggagtttgtgataagctagatctggggaagtcatttagggaattgagttactctcacagtgcaaggctctgtgacatgaaagacagtctcaaagattctcatggggtcagactatttgaaaccaaaaggcagtggagtgggagtgacacgagggaccgcatctgacatggtttctacccttgcgtgttcttgtaagtatacatatttgcatgtacatttgtatggatagctcagtaaactcattatagtttcctttgacatcatcacgtgtcattgggaaacaaatgtaatccaagaccttcaaatgatgttgcagttttaaaaaaataaactgctttctctgctattcccattataaatgcaaccaagcctatggccttatagacttgctggtctcaaagcatgtgtttgaggtgggaaaaaatgtgtcatgtccaaggaaatgatacaagatatactttgaaaatagaactgataggacatagaattggcctgaatgtcaggatgaggcaaaggagatgaggaccaaggcggctgctaggtcttggtgaggagccctgaacaggtgaagagtccccctaccaggaataagaactaggggacttgctaaagcaggaatctttaatttaaaatgcagaaatatttaaagagagaactttaagaatccaaggtataccagctgatgctaaaagacgattagccttgctttgaaacggaagcctagtcagaaaagtaacaattccatcactaagatgttgaaaaaggctcttcaaacattttttgctctgactcacagtaagagatacatagaataaagacattttatcttagaactcagtaatgcatacacataaatacacacataaatatacaaacacacacataactttatgtatgcacaggtgtactgaaacaagctgcagaatatttatcaccactatttgatacacactgatacattctatgctcttttatttcatttttttaaaaagtaaagctgcaatccatgaaactgatttcacaacctattagtaggtgaacccaaagtgtgaaaaaccattatcccataatattaagtggccacaacatagtgttagtttcattctttatggtggttcctatttttccagattctttcccataatcctatgccatctgtatcaggtagacaaactttacagttaattttcaatgtgttttgccaataagcccagtgtcttaaattccttttgggttgctaacacagaccaggtaagcatagtcactgtgggttgaagtgccgtgctctgaccttccttcacttattttttcctttttgtatgtgttgctttttaatcagcactgtattgtgcacccacaactggaacagacagtcaacctgaaatacacattcccttccagccccaaaatgcagaaatcttgtgggacagtaaataatgctgatgtacctcttctaaacatgagtccgcctgatacaacgagcacatccaatagcattctcttccttcccctttccatatctctataaagggctactttcaattccccaaagtccaaaataagtcagccatggacagccagtgccacaccccgtggttcttattcctggcaggaggactcttcacctgttcagggctcttcaccaagacctagcagccaccttggtcctcatcgcctttgcctcatcctggcattcaggcgagttctatgtcctatcagttctattttcttttttttttttttttttttttgagacggagtctcgctctgtcgcccaggctggagtgcagtggcacgatctcggctcactgcaggctccgcctcccgggttcccgccattctcctgcctcagcctcccgagcagctgggactacaggcgcccgccaccacgcccggctaattttttgcatttttagtagagacggggtttcaccgtgttagccaggatggtctcgatctcctgaccttgtgatccgcccgcctcggcctcccaaagtgctgggattacaggcgcgagccaccgcgcccggcctcagttctattttcaaaccatatcctgtgtcagttccttggatatgccacagtttttcccgcctcaaacatacttttcctttaaccttgttcttagctctacttatccatgaataatcccttcttatcttcctaccttctgtggctctgctgaagtgcacgtcctcagaaatccttacatacacaccccactccaaacccccaccatctaaacagctcttctctttactagagtcaacttctgtttctcaattcatgtaaatgcatttatgagagtggatttattttctttgtcaatgtactctttttgtctgtgttcccaactgaaatatttgctttcaaatgtcagtggccaaaaccatcttgttcatcgtataaataaataaatacaatttataagttttacgagcttctttggttctttaataaaaaattcttgaagtgattcatttaaaagtaaaggaattatacaattatattctttctaaggattcattattttaaacaactagaaatctaactagagcaaagattagtgacagacttgaatatctgcacaaagatctgatcattaacaaactaaatagggtaattaggtatacagttggaatgcagtatgcaggcttaaattagtagtgtataattgagcctcatttaactgcaggagaatttcactgagagaattttatttacataaaagaaatgtcttagtgaaattgctttgagagaatttaaaatatgtacaccaaatctctccttacatactggatccagcagaattgtaagcttattcctcatgccccatgtgatggtgttatttctagccaaatgatttcttccaggcggctcaagatccacgctggggcttcattatttcttggatatcttgatgatactctcataaacataataggctccaaagaaggttaaataaaatgatatggtgagagctctgccccctcaatatgatcccttattttactgatcctatttttagaaaaaaactcgaagtatgtatatcttctaaacagtcacttaatttagcactgtgcaaacctttgggggcagcaggtaagtggggcaaacaagaggatccctttgtcttcagagaggcaactgccattttgaggaggcagctctgacacccaaatcaactggactgatgcaattatgtgtgaaatggggaattatcacagaagttcaggaagagacagagatcagctacatggcagattcaacttttgtgtgaggtatttggaggggagggaatacaaagaccagggtgaatattgaaagtctccccttctgcttttaggcaagtccaggtagcgaccagcttgaaaagcaagcataataaaagccctctttgacgcatctactcccgacagcaacatcatcctaaatttatctccttctatgttgtgtgttacatgggtttggtttacgtctactgtgtccatatgctcaccacccactgacatctttttccaaaatacattttaactacccaagaagcacattaatagagtcttcttttaagatactcaaatacgtgacagtgggaaatgaaacataatttctcctccccttcctctaatccactcatgatttcagaggcaaccacagttaacatttgggcagatatctgctgatccaggcctctctgttcatttgcatacacaaatttattcatataccactgcctttggtacataacattacagattgttatgtaaccactttagactatgtagtggagatttttctgcagggtatgtgtacatataccttactgtcttttatgtaactgcagagtatagatgtaccctaatttatttacttatttatcccttgattggcattcaggtttatgtataagttttcattgttggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaaaaaaaaaaaaaaaaaaaaaaaaaataagttttcattgttaaattatgcatccgtgcatttgggggtgaacgtcaaagtgtgcacttctgagtttttccataggataatctttgacgttgcaagagggattgaaaagtatgcaagtctcacacttgaaatatactggcaagttgcccttcaaaaatcaaaaggcttcaccaatttacatgcccacctatagaggtttttatttcccataccttttgtcaagaccacttattttcaaacattttattttttgttctaatctcctgtatgaaaagaatctctcattttaatttacattgatttgttcaagttctaagtaaattttgttcagcaattaattaaaacgtaattcatttcacttgtgaaaaggtgacatttttgcaatattaagttgactaatcctagatttggatatgcctcttcatttatccagggcttctattatgtcatttggtaatgacgtggagtgttctttaactcaattttgtgcatttctagctcttagacacttaatatttttattggttcagcaagaatattttatcatattttattacagattagagctactctaaagtgcttttctctgtcaggttcttacatggatgttcttatttaatatcatgattttcccaaaaaggcaatattgcccctttgtacaggttgtatatgtactcaaggctatggcaataggaaggcagggagctgaggccctttgcagcatcctttagaagtcctctcctcccctggctttcttagcgccacactggcttgtgtcctccatgcctcctctcactcctttcctgggtcttttcttggccttcttccttcactcgccttccttcactccccttcctggggagttactaaacttcagttctcatgaagggcttctcctcaacaagcatagtttggtctccaacgccctgtctgcagcttgacttttttgattttaactgactcagcatgctcacagctgagctcttatcttttctgaaacagaatctcccctaccccaactcctttgttctaccaaggccaccccaaccccataggtccctcagaatcaatacctggcatcttcttctcctcaccccagctctgttgaacctttaggttaaatttctttctgtgctcatggcttctgccccactctggttgtacctccgcttgcccatgccttgccgtctcacacttgtgccatggcccaaacccaggggagcgatttgcgtgagggcatgagccagcaagccagggcaccatcctggcacagatacttctagttgtataaactggggcaagtccctgaacttctctgtttctcaattttctcatctgaaaaatgggaataacagtatcttcctcttggggtcattgtaagaactaaatgtgtcataacataaataatgccgaaagcagtggtagcctccacctagaacctgttggctctgattaggattcatgttaatatccatgtctctatctaaattttccctttttataaggacacaccggtcacattggattaggggcacacactatccaagtatgagttcatcttaagatattacatctgcagtgactgaccctatttccaaataaagtcacatcccgaggtactgcaggttaggacattaacataaatttttgaggaagggggaaattcagctcataacgtcaggttagatgtcttctctttagggggctcttcttttctcttatatgcagctttcaacatgtgcatatttttatctggcaactcaattgctcaggaaatatctgtagctcgttcatgcctgcatgtaatcctttatatatatcatatatatgatatatagatatctatataagatatatatgatatatatgatatatagatatctatataagatatatagatatcgatatctatataagatatatagatatcgatatctatataagatatatagatatcgatataagatatatagatatcgatataagatatatagatatcgatataagatatatcgatatctatataagatatatagatatcgatataagatatatagatatctatataagatatatagatatctatataagatatatagatatctatataagatatatagatatctatataagatatatatgatatagatatatatatatcttctatttccacttctattttagttaatgctaagaggatcatgtggtttctaatgctatatacttagaacttagatttaattcttatgttcctctaatatttcagaaactgttattgaaacggctttgaagaaagctgagtttcatgacacagtgtggccatcaattggcgacggcaggcgcagctgagaaaagcttcatcgtgcttgtgctaccatttaacatcttattagcagagccatctcttctttcaattgctattaactcaattcatatagactgcaataggaaaaacacaacaacaagagctctaagatatatttctctaagtgaaaaatgacatatgcttttaaaatcttcccccaaatagtattgcctttactgaagatctaacagcttaaccacacagtaaaaagccagggagcataatgaaagaataattcatcacaatcttaaaatatgctcattttcatataagaatatattcatctctggaggagaacaaactctttttatgcagtctacatgaggaaatgtgccgaaatctaaaaaaaggtactttagctttctttttactgagacctaggaaaggatgttttgaatacaagcaataatagactgtttcatccacccatgcatgcattcaacaaatattttaggatgtcatagccaagtactgttctatgtaatggagatgaaatgttgaacaagacaaaatgagttcttgctattctagatgaaggagggaaatgttaaaccaatctcatgcacatgtacaagataacgtcacatacaggtataataaaaccaagtctctcatcatgaatgaccatgatcatgtgactttgctggaaatttgacttaaaaactgaggccaggatgacaagaaggacccatccagggagagatctgggctcagagcctccagtcagagcaattaaaagaagtacagcatggcctgggtatggtggaagaaggagagagtggagtggaagcttttggagatatggccaaagcccaaactatcatagaccatcataagtggttaggtctagtgggattccatcaaggcactaaatgatgtatattgctaaatgctcatgcatgttgaatagagattaaattgtagggaagcagaagtggacacagagagtttgaaagctacaatccttagatgtgtgtggtacagtgttgagggaggaaagtggatggattcaggatatattttggaggtagaagcagagggccttcctgttagataaaatatgatggacaagaaatgattaattttgagaacttcaggatattttttttatactcagatactaacagatatgccagggagaattgttcaagtaacatgataatgattttggggaaagtccctgagtttctgtgaatatccatttctactgtggaaaagacttctgaagataatatcttggtcagcttgggctactatcacaaaatagcatggactgggaggcttaaaccacaaaaatttatctctcactgttctggaggctgggaagtccaagatcaaggtattggcagatttggtgcctgatgggggctcccttcctggattgcagacagccgccttctcactgcgatcccacagggcggaaagagaaagtgaggtctggtcccacccttataatcacacctatacctaattacttcccaaaagctttatttccaaatactgtcatattggggattaagaattcatcatataaattttgtgcagatgcaaacattcagttcatagcagatgtctgtgatcctcctttccccaagcctttcactggggtatacaaaaatactccatggactcagtatatctttctatgtttaccaatgctctgtcatgtgacattggctcagaggtttagtaaatattttgcctgtggtgaaatagctccaaatggcagaattatgatgtaaaattcatctacatcattaccactcagatgctttctttaatatatgcggttgcctttcataagtaagcaaacaagcaattgaaagggggccctgctatgtttatgtcagtgggatcttccctgtctggctcacaaaggctacattttatacacctgtggattgtccagaacagcagaataacaaacatggcatttactaggatagataccaatttaattttttatttattaatatttttttcaattgaaaagttatatacatttattgggtacaatgtgttgattttgtatgtgtctatatatacacacctatgtgtatacacgatgtgaaatgattacatcaagatgatgaacatatctaccacctcacttatccctttttttgtgatttgaaatttactctctgagctattttgaaatatagaatacattattattcagcttagtcactctgctgtgcagtagatgcatgactatctgctagatgacataaatgcattttaatttgatcttcaacagcagaacaaagagattactcatcatctctcttttttctagatgaagaaagcaaagtttagagttaaatgactagactgaggccacacagctggaaagggacaaggaccgttttgtagttcagatccactggcttccaaagcccaggttttttcttccacactgagaaatctctcaaagtggatgagcttattgcacctcaaaccagggaaaatcttttaatttgattcttcataagaacaagaaaaagttagctgagaagattgaacaagcacattaatgatgaggactttaacatataaaattaagtatttgtattagaataacacacaaggataaaagcaggtatggggataaataccagttttcctccctgggtatcagtagccccttcatcccagggagacaaggacaatgccacttccttgattgctctccaggttcttcccttctatcctttttcctcaacttcttgggatgttcctaaacccaaaggctcaaatctgtttagattataagctccctagagataggggctgtctctctcctttttgcatttctggagcctaggacagtgctggtccaacgaatgggtgcatcacttggctctgtttcctgaccacctataacacctgctggtttctagaatcaactctgatgtgcctctttctggagatcatgcatgcctgctttctgcggctcagatcttaaagatctgactttcagcattaacaacccatagttcagcaaaatagatttctagaactgctgctattttaatatctgcctttgaagaaaacccaaaatggtgttgtgcctgagtttcagaacccactgctctatgagtgttttttgcggctcagctccgtgacaatgggaagaacgtggctgtagaactccaaatctgagggtttctgcaacattttcctactgggctaatgccccattttctttggtagttttgtgtccctacatagaaatatcccactggcccctatgctaatcttaaccaggctgactgaactgacaccaagcgctggatttattttagtggcactaacatgtaagctcatgttaactgatgttggaaaaccactatgttacttgctcataacctatttactcttagtttatacaaagtcctaaaagccttgatatgtctgttttctaactctcagcatactgaatgcatcacactgtgtgttgacaaagatactgataacaaagggaagtaacatataacagctggatagtaaaggaggaagcagaaaagctaataaagacaagctcagagacttgaacatctggcagtctgggaccattccatgcatcttgagatgccacatagcttctgagacatccctctggtaactgagcagcatggctcaataatcgatgtccaaaatgatgactcaaaatccaaaaatcattccctgttcagtaggctctaaattgcagtgtgtctaacatgacaaaaagtatgaactatgttttagaactgtgtccggttaaaatgctaatagtattccaaggaaaataaaacagaaagacacacaaagggagacagaatgagacagaattgtgtgtttgcactttttgctgccaataaattgtatttaaacatttgcctattttaacagaagcacatccattaatcccattgaaggacatgaacaaaccatttaatccatatgacatggaaacctttggtggcataaggtagcaagtggggtacagtggcaagttagggagcagttaaaatgattccttgttaccacagggctgacatatttggtgctctaatgacttagctgtgtccttgttgtcccttgatagttccacaggactcctgagttgagactgtacccaaggaccctggacttacctgttcctctcataattaaaagatcctacttttcaaccttattttatgttttaaaatgttgatcaatttcaagatgagataaattgagaaatgaaggactagacaaaggaggtcaaattaacccatttatgcctgaggttgcaattttttaaatttttgcaatcagaccttggcaatgaccttgagcagcaggaaataaataattgccacatgcttagcgttccaataatgaaacgctaggcttaaatgggtttacgcacagaaactcagttaatgtcaactccttcattcctgtaaacatctcaaaaaatgcttaagacaatcaaaggttcaagttcttctgaaatgatacgccctaaagccttatttaacgtaagtgggtaaacgaaaaaaatgttagatattacaagaacaaaatgttcctagagaatagagccctctctggaatcagtaataatgcaggctgctgctatctgtgtgcatttctcaacctttctggaaaatggcacacaaaatccttcccacttgtattttgccaccactcatggcctatcaattctaatgaaaatactccacgctaagaaggtgacaggaattacatacatcatctttttttttttttgactttcctttctgtctatcaaactgtactttaaaggaactgattattaaagcattatgtaagtatgcaaaatatattgaaagagaaataatgtttccattatacacaatgtgtatcataagaaaggctggtgtgtgatgacacatgacaagtggtaaaaggtatttttagttgctttcattttggggaataataaagcaaaattatctggaatatacagcattaggagatttttcagcttctctaatagctagcattatttatggcatattttaaactaaatgtctaactggaattgtttggaaagttaatatagatattactttaaagatattttatactacctttaataattaatttgcgctcctttgaaaagcttatacaaggtcagtatttgctctgttattttatgatctttttcacatctgtgttctttggaattactcctaactcatgataattcataaatcatttttaggctgggcatggtggctcatgcctgtaatcccactttgggagggattacactccctggcactttgggaggccaagacgggtggatcacttgagctcatgagttcaagaccagcctgggcaacatggtgagatctcgtctctataaaaaaatacaaaaattagccaggtgtgatggcccactcccatagttccagctattcgggaggctgaggtggaaggattgcttgagctcaggaggtgatggctgcagtgagctgagatgataccactgcaccacagcctggataatacagccagaccttatctcaaaaaaaaaaaccataaaccatttttaatttatctgagaaactgacctatgcatgatgtgtagttactgcagaaaatgaccaagaaattatctttacaatttaaatatgtaaagctcaaaagcaatgaagctaagactcctggaaattctgactgaaataaactaaaggatgtttcaactgaacctgagaaaaataagcaataaaagttgattatttggcattttagtcttttttcaaagataaaaatcacattctttctagtggaatcacatcacatgcagaaatagcccatagaagagtctaacggtggcaggaggtgtactgagttacccaccgggaaggtgcaatgaggcactctcagctctactttttttttttttttaaagtaaaagaccagaaattttattatcttagggaaattatagaatccacttacgatgatcatttacattttacctttatgctccaacttgttttatcagccaattaaaattgaacagcgaaaaatatctttaaaagttacattttcaaagggaaaaaaacatttttgccctcttaaactaacactgatatttgatctcaatgttggccctttctgttcaactgaagctttaccggtaaaaattagaggttacagataggacattgttttgtgctgacataatggggaatgactgatcatgaattttttttcttgaggtgaaaattgttattgttagtgatttgaacagtccctttaaaaattagtgattaagaaataacagagtattctaaaacactgaatctgggaagaattgatatgtgtcatagaatatagtgataaatattggttattaatgtgaggaaataagacagcctttttaggggaagtttgtagaatattttattgctttgtagtctaatatttttgtgcttttattgaaacattttaaactgaggcaaaagtttatactttcataagctagagatgtgcaacaaaaagttaatattcccttaatttgtcacattctaagggaaatgtaatgatccaagaaaatcttctgtgttcggtatataccaattatatgacaacttcgttgctgtaagataaatgcatgatctaaaaaaaagtttatgaggttagatttgctaagtatatatttattgtatagcataaggactaaaaacccttaatgtaggctagtcaaaaaattaaaacagcttggacccttaattgacacacacacacacacacacacacacacacacacacgcagacgcacgcacccatttttagccttttcattaagtttcttcaggtgggggaaaaaaaaaactgtttaaggactttgtctgtgtggttgggttgctttcattgtcttttaaccaagccactgttttcctctatttcaggatctagatttctcatcacatccacgggagccttgtatattaaagatgtacagaatgaagatggattgtataactaccgctgcatcacgcggcatcgatacaccggagagacgaggcagagcaacagcgccagactttttgtatcaggtaaaaacttatcaagactctgtctgctatgtctgctatttctttgttagtgtcctgagacgactcaatcaaaattgtggagtgttgccactaaaatggagccttcaattccttttccaaaatattttaggaattttaaaactcttttaaatgaatatgagtacaatttcatagaaatacagatttcacatttgtcaaaccagtaattgacacattcacataatgatgcgttagcatttcagggagcacattaggagtgaaagatccatctccatcccaaatatccatctcaaatgcagtcaaattgcatttgatttgattataaaaccaaatacaaaatacccaacctttgcctttgtagctgaagaatataaaattgcccccctgtggtaaatatcctataaggttgtaatagtgagatggaagtgaccaaaggttgcttgctatcaatatttgagaagtaccttatttgtaataatgctttatgggaagaagtgaagggaacttgttgaacattggaataatttaaaacatcactgcctgagcacccactttttgtccttgataatgtactgttgggatttttctcttcatcacttacatcttcaaaatagccaatagtctttcaaggtccagcacaaatacaagtcagaattaaattagttttcctttgaacttgcaagtatttttgtttctttatctgttcttttacaagtcaattgctattttctcccttgcttttatagttatcatgtcttttgggggaaaaatgaattagaaaatgaataataactatcatcttagtccatgatagctttaaggagagcacaatattctgcttattcagaaaatcctagaaaacgtcctctttgtgttaaagagaaattttctaatggcatgttcagaaaagaaaggggaaggattcgaggtaggagggggatcctgatataaaattaatttgggattcgcaaaattagtaaataagcatttctccctccaaatgatgacataagtggtgatgatctaagagcccgtctttctgtttcaggtgaccttttttatcttcatgctgaatcatcaagtgttgatttttaaatgtatctctcagggttggaaaggcaagtttactttccttaatcccacgatgtttgttcattttttgttttggagtgattcactaatgtttcaaaaatggacagaagtagtcacaagcattttgtcaccatgggagtcctaggattgcctagtgagcattggaaaagtgagagcaacaatgtataatccagccagggaatatcatacactaagccacctgccgaaaagtagccaaggaataagactgagcattcaggactaacagtatagatgaagacagggaggtgatagatgccaggagaagggaggggtccacagagtcacatgccacaaaaaggctcatatgagagtctaccatatgtggaaaataactcaatattttttgtcattgaaattttaataaagcagttgaggaagaaatttgttaatgctaaaagatgagactgtagacactgaatacagaatgcatttctaacatgtcaagctttgaaggaaaagagaaattaatttcattttaaattagatttaaatatactgaaaaatgtacatctggagtttgggtcatggtggaaacatgttggtgtttgaccccaaactcctcctgaaaccaacacagataaaataggatgacaaagaaaaaagtacatggatggcaccttcaacacaactggattactggcaacaacaggaccagcagcagaggtggaaggcagtagaaggggtcagcctgttgggtttatggtagtgtcagaaaactgcaaataaccaacgggtccccatctccaaaagcagaggagaattctttgtgtcttagagtcctcacaacactgggatagaactgcatgaggtctaggttggagatgagtcacaaggccattagagtggctggtaatgtttgcacaggccagtgatggtctatgtccttgaagatagtggaagtactcagcaagtactcctttcagaagaacagagactcactctcaggggaacggctcaatttagaaatcaaattgagccagagtagaatacaaagagtaacagagaaggctcgggaaccaggggaggccctagagaattccatcctatgaaatactgcaaaagaaaatacaacacgcacagccttagaatgtaaaaaacagtgttctaggaaacacatggccagaagtggaagcccatacagttcaatcccatatagctctgagagatgggctaaatgtcgagtccttgaaggtaatatcaagggagaagactggaaaaatatactcatttcatcctctcctgcaggaaccttctcctaattaactaagaatctctatcttattgtaaaatgaaacaaaaaggaaaaagatttaacccaacacaactttatcacaagaaaaagaatgaaaatttttaaaaaagttttgattataagtaactacaaaaaatactgacaaatcatatgaaaactatatttttttgtttgaaatgattaaagctttgaaagagcagtataaatcagaaataaaatgatgaaacaacacaaatctgtgaaacaaaaagtggcatattttggaaaaagttagaaaaatgaagagttctaaaattaaaatgaaatgacagggaacacatcagaggataaacacaacagaaagcataatatgggaaatcaaaaatattaaggaataagacaaatagagttaaaaatgtatagatgtctgacaaagatgatgaaacacatgtataactaaattctcttaaaaagaaagccaagcaattgatgagaataagtattaataataaaacactaattcaaaaaaagtctcctgtcattaaaaagaatgcataatgactacatattaaaatggcacaaccctacctggaaaaatggacccagaatggtcaacatgcaacatagtctaataaaatttttgagctgtaaagataaagaaaaatatcatttagacagccagaaaataagttcaagttacttctaagggagaatataaacagactaatgaaatagaaaatagaccaaaagaacagtaaatgtaataaacaagttttttctttaaaaaaaaagtcagtaaaatagacaaactgacctaatattttttaaaatggtcttgatttctgtgctagggctagttatttggacaagtcattctttctctgaggataactagaaagacttgttaaatgtgtaaaaaacatctgctcatggctgttaggagctagagtgaaaacttacaggaccaaattccagaggaaaacagccacaagaagtgagtttggtattgaggactgccttttcagtagggacagttttagaggagattgctgaaactccgagaagatgagcaactcttctgaaaggttagtagtgtctagaaggtaaaaattggagtctagtctctatatatgtattagggttctttagggggacagaattaataggatagatgtatatataaagtagagtttattaaggagtaatgactcacgtgatcacaaggtaaagtcccacaataggccgtctgcaagctgaggagaaagaaagtcagtctaattcccaaaaccttcaaagtagggaagccaacagtgcacccttcagtctgtggtcgaaggtccaagcgtctaaaagttgaagaacttggagtctgatgctcaagggcaggaagcatccagcacgggagaaagatgtaggctggaggactaagccagtctagtctttccatgttcctctgcctgcttttatcctagccatactggcagttgattaatggtgcccacccagattgagggtgggtctgcctctcccagttcactgactcaaatgttaatctcctttggtgacaccctcacagacacacccaggaacaatactttgcatccttcaatccaattaagttgacactcaatattaatcatcacattaaatatatttgtttatatattatatattatagatactcatttttatttatagtagcatatatagtgggataagtgaaaagtgattatgtttatgttatttttatttttattttcagtataagagaaaaataaaagtatgaaattcttttataattcttgaaaatttatagaaattcttgaaatataacaaaaatgtaaggcatttatacaactgaaataattatttctaaatactttacatatgtactttttatcctaagctctaagagaacagatgtgccttagtgtgtatatatatgtatgtgtgtatatatatatatatatatgtatatatactagtgtgtgtatatatatatatgtatatatactactgtgtgtgtatatatatatatatatacacttttttttaattgtactttaagttttagggtacacgtgcataacgtacaggtatgttacatatgtatatatgtgccatgttggtgtgctgcacccattaactcgtcatttaacattaggtatatctcccagtgctatccctcccccctccccccatcccacaacaggccccggtgtgtgatgttccccttcctgtgtccatgtgttctcattgttcaattcccacctatgagtgagaacatgcggtgtttggttttttgtccttgcgacagtttgctgagaatgatggtttccagcttcatctatgtccctacaaaggacatgaactcatcattttttatggctgcatagtattccatggtgtatatgtgccactttttcttaatccagtctatcattgttgggcatttgggttggttccaagtctttgctattgtgaataatgcctcaataaacatacgtgtgcatgtgtctttatagcagcatgatttatattactttgggtatatacccagtaatgggatggctgggtcaaatggtatttctagttctcgatccctgaggaatcgccacactgactttcacaatgtttgaactagtttacagtcccaccaacagtgtaaaagtgttcctatttctccacatcctctccagcacctgttgtttcctgactttttaatgatcaccattctaactggtgtaagatggtatctcattgtggttttgatttgcatttctctaatggccagtgatgatgagcattttttcatgtgtcttttggctgcataaatgtcttcttttgagaagtgtctgttcatatcctttgcccacttgttgatggtgttgtttgtttttcttgtaaatttgtttgagttcattgtagattctggatattagccctttgtcagatgagtagattgcaaaaattttctcctattctgtaggttgcctgttcactctgatggtagtttcttttgctgtgcagaagatctttagtttaattagatcccatttgtcaattttggcttttgttggcattgcttttggtgttttagacatgaagtcctttccctaaattttaaaaaatgcataaaatccttgaaatgtcaaattccaatagaaactattggtatttgtggtatgcgtggtggctcacacctgtaatctcagcactttgggagaccgaggcaggcagaccacttgaggtcaggagttcaagaccagcctggctaacatgatgaaaccccatctctactaaaaatacaaaaattacccaggtatagtggtgggtgcctgtaatcccagctactcaggaggctgaggcaggagaattgcttgaactcaggaggcagaggttgcagtgagccaagatggcaccattgcactccagcctggtgacaagagtgaacttccatctcaaaaaaaaaaaaaaaaaagaacacaaaaaactattggtacacacttcaaaaaaaaagtatgaattttcagtctttccactgagaagtcccagaagtgatgagcaaacaatagcaacaagcccctctaacatctagattgtagattcttttaaatataattcactactaaaagggaccatggcttcttggaggagtggctgattgaaggtctgaggcaggaaatgtctgaggtgagtctgaaacatgaatggggtcttgtcaaaatgacataggaatcaacataaagcggctctcgtcagccaaaggggatgaattgagtatcagcagtgatgcttgcacatgattgataaccattaaatattttgaaaacctttgagttcattttaattttatacatacatgtgtgtgtatatatagatatatacacatatgtacatatatacttacatatgcacacctgcatatatatttcatataaagaaagaaagaagaatcttattggtctgcatagtagaaaccagggcactaactcttcattctgataacagatgattaaagacaacaaccactaaatgtattgtctttcctatagctgctgtattttaagataaccaaataaccttagttcagaagggaaagttcattctgcagaataattatatctactgaatgcgaacgaaatgacacaattagaaaattccattttcaaccttagcaaaatagctcagataaattttaacatctgacctcactgaacaattgagtgtcactaagaacgggaaaaccatacattttgtggaagcaatgtgaagtgcacagcacccctctcaaagagagagaggttgaacacttatctaaccaacccactgaaataaattccagttcataagaaaaatgcctatggcaataacggaacaagttaaatgatgacatggacaagcaaattcagcatggtaactacctggtttctttttttttattattattatactttaagttttagggtacatatgctgctataaagacacatgcacacgtatgtttattgcggcactattcacaatagcaaagacttggaaccaacccaaatgtccaacaatgatagactggattaagaaaacgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgggaattgaacaatgagaacacatggacacaggagggggaacatcatacctggtttctttaaaaagccaagtcaaatacatgggagaaaggaggagggctagctctgcattaagaaacactcaagagatgtaacaactgcatgtgagcaagagaaggatcttgatttaattaattcaattgtttaaaagctagccacttttgagctgatgaggaaaaatgaattgggagtgtataatacttgatattatgtaatactgactgtggttatgtaacaaaaccgtatttttattagggaaacatgctagtcatgtaatgataaaatgacatagcttcccttttttgttttttgttgttgtttgtttgtttgtttgtttgtttttgagatggagtctcactctgttgccacactggagtgcagtggtacaatctcagctcacttcgatctctgcctcccgggttcaagtgattcccctgcctcagcctcctgagtagctgggactacaggcatgcaccaccacacccagctaattttttgtgttttagtagagacagggtttcaccatgttggccaggatgggctcgatctcctgaccttgtgatccccctgcctcggcctcccaaagtgctgggattacaggcgtgagccgctgcacccagcctatagtttcccttttgttgcatatactttaccaccaaaaacaaagtaaaactatcaagaaataaacatgacgaaaaatagaaaaggtttggtgccagagccattaatatgatgaatatatgggatgcgtcatattatttttgtctacttttctgtacgttttcaaatgtttggggtaaaaataatttttgtaatatatatatatatataaaagtttgaagactttgagacaaaaaaaaatttgaaggggatgaaaatgaaagacaatgccgttcggttattcagatttgatatatgaccaaatatccccacaagagcctgtctcaagcattgcttcaatcatgcacttaaaatataaaacatcagatgctgtgagggtgcagagaaaagggaacacttatacactactggtggtaaagtaacttagtcctgccattgtggaaagcagactggagatttctcaaagaacttaaaatagagctaccatttgacccagcaatcccattactgagtaatatatccaaaagaaaataaatcattcttccaaaaagacatatgcacttgtatgttcatcgctgggctattcacaatagcaaagacatgaaatcagcccaggtgtccatcaatggtagattggataaataaaatgtggtacatatacaccatggtatactggaaagccataaaaaagaatgaaatctcattctttgcagcaatgtggatggagctggaggccataattcttagtaaattaacataggaacagaaaaccaagtacctcatgttctcacttataagtaagagctaaatattgaccacacatggacacaaatacaggaacaatagacactgtggacactagactgtggaaggcagagagtttaggttaaaaagctacctatcaagggccaggcacagtggctcacacctgtaatcccagcactttgggaggcctagatgggcggatcacaaggtcaggagatagagaccatcctggctaacacggtgaaaccccgcctctagtaaaaatacaaaaaaaattagccgggcgtggtggtaggcgcctgtagtcccagctactcgggaggctaaggcaggagaatggtgtgaaccccgggaggcagagcttgcagtgagctaagatcacgccactgcactctagcgtgggcaactgagcgagactctgtctcaaaaaaaaaaaaaaaaaaaaaaaaaagactacctatgaagtaccatgctcactacctgaggaacaggatctctactccaaacctcagcatcacgtaatattcccatgtaacaaatctgcacatataccgcctatatctaaaataaaagttgaaataaaaaaataaatacctcattcaggtttcgtaaaacagttttgttgagaggtagtttactttaatataaactccatccggtttattcaattcaataattttagtaaatgcatggagtcgtgccacaattacgccaatttaattttagaatattttcaccacccaaaagattcctcctacccgtttgaagccaatttcaatgtccatccccagtcccagacaaccactaatctatggtctgtctctgtagagttgcattttctggatatttcacataaattgatatatggattttgtgtctgccttctttcatgcagcacccatgttgttacatgtattagtcattcattctctcttgttgctggagagcatttgctcatctgtaaatactgcatttggttatcaattcactaaattatgaatatttgggttgtttccactttttgattatgaataatcctgctatggacatttgtacctaagtctttgagtgaacatgttttcattcatttagggtagatacctagaacttggggccttatggcaaattgaagtttaaacactttaagaaaatgccaacttgttttggctgcttttatttggcaagtataccacaatacacctggggaaaaaataaactctagccaatgtgatgtaagaggagaaaaatgtgtgggtttgtaggaaattctgcttaaaagtgacttcactgagggggcattcttaagcatttttgctgtgatgtggatgtgaaggctggcactccagcaagccatttttacgtgagatgtatatgtgtgcatatgtaagtatatattaccttccaccaacgatgtatgaagattccaggtccccatatcttcaccagcattgtttgtgattttattgcagtcatcctaatgggtgtgaagtcatgtcttactgtgattttaattcatattaccctaatgcctagtaatattgagcatctttttgtgtactgattaggtatttgtgtatcttctttggtgatgtaaaatagtcaactattttgcccattttgattgggttgtttcttttcattatagagatataagcatttttaatattttttggatttgagttctttattagaaatatgattttcaattttttttcactttctaaatggtgcctttgaaaatgctacagttcttaatttttttttttttttttcgagatggagtcttgctttgttgcccaggctggaatgcagtggcatgatcttggctcactgcaacctccgcttcccgggttcaagctattatcctgcctctgcctgtagctgggattacaggctcatgccaccacacctggctaatttttgtatttttagtagagacggggttccaccatgttggccaggctcgtcttgaactcttcacctcatgtgatctgcctgcctcggcctcccagagtgctgggattacaggcgtgagtcaccgcactgggccagttcttaattttgaagaagtttattatgttgattttttctgtttttgcttgttttcttagtgttatgcctaagaactcttcaaggtcatgaagatattttccctatgttttcttctaaaagtttttatagttttagctgttatatttaggccataatccattttgagttaatttttgtaggtagtgtgaggcaaggttctaaattattttccatgtggatatccagttgtctcagccattttttaaaaatgtcattagaattacatagcactatcttaagcatatttgagaaatttctgccaagtttcagttagaataaaactttttaagtgcagtcattgagagttgattttttatgaatagcattagaagttggtgcatttcattttcagagattgtgggattattctgcaaagaaagtcagaggtgcacactgtggtgtttattgtcagccacccctgccaaaggggtgacatctttgtgccaccttctccaactctacttctacttcctactctaagtaaaatgacagattttgcagctattttttcatagtactttctaatatcttcaatattccactctagtgtaactaaaatctgtattactgaagaacgagagctatcattatattctcacattttttgtttttgtttttttttattatactttaagttttagggtacatgtgcacaacgtgcaggttcgttacatatatatacatgtgccatgttgttgtgctgcacccattaactcgttatttaacattaggtatatctcctaatgctatctctcccccctccccgcaccccacaacaggccctggtgtgtgatgttccccttcctgtgtccaattctcacatttcttaattaaatgaagacagagttcagaataatagagaagcttaccccaagtaatacatattatcttggatgtgatttctacttactaaacaatattgcaatggtgtttatatggtctgcaagttagtgtactaggaattaaaaaatcccatgtggttaaggatgtccaggaccatttctggagctggctttaggcacaactttgtgtcttctagttcactgaacccattgggtgtgcaggtgatgatacttccagtaacatggatgcagacagctaaccatttttctggattcttggttcatgctagaagatgccagagatcagtgagacatcattggttaggcctgtctccacttaattattcagtctatgggaacataacttgatcttcaaaccaatacttttcaaagtccgtttgtaatttcctttagaagcaggtaaatgaagcaatgaagtttttgctggcacaggctctgtacctgggtattgtgaaacttttatatctctcttgccttctggagccctatagtcatgcatatgaatgactgtaattctggaatatagaattcttcagttaatgaagaattagaggagtcctggaagctcatcaagtattctttaaaagagtatttaggttccctcattatatcactgtcataagacaccagtgaagtaaaaagagcagcaagttcataatgaagttttatctctgatgatcacaaaagaaatagaaagccaagacatttcagctaaatgtttttgttctattttcaacagtgcctgctgactgccctcagtggctgactacggaatcacagcctcttaaagaagtcttcctactaataaatgattttttgatgttattgtttattaaaacagaaatttactctcttgtatataagtccagaagctggtttgccagcttcagtttcacaagggaccaggcttttatctttctgatccattatcctcacgtgcagttccattctcaatatgatttcaaagtccaaagtgattgctgcagctcctacctttatatccaccttccaggtgatgtaaagaagcaaaggaaaaatgcataaaaacacccctcccagctaagtcgcctttaagcagaatttcctacaaatccacacattttcgcctgttacatctccttggctagagtttatttttcctccaggttaattgaggtattgaaaaatgaaaattgtatatatttaaggtatacaatgtgatgtacaatgtgcatatatatatatatatatatcactatcaagcaaaataacatatctattgcctcacatagttaacatttgtgtgtgtatgtatgtatgtgtgtgtatgtgatgacaatgtttaagatcaactgtctttgcaaatttcaagtatgtaagatagtgttattaactgtagtcactgtgctgcatagtaaacctctagaatctattcatctggcataactgaagctttgtacccttttacctaccatatgatctagcaatcccactctgggtatatatccaaaggaaatgaaattacatatctgcactcccatgtttattgcagaatcattcgcaacagccagaatatgaaaaaaacttaagtgttgatatacatatacacacatgcataggaatatcattcctatatacacaaaggaatattattcagccttaaaaaaggaagcaaatcttcccatttgcaatgacatggatgaacctgaagggcattgtgcttagtgaagtaagccacgcacagaaagacaaacactgtcttttctcacatacatgtgaaatctaaaaaagtcaaactcagagaagcagggaatagagatgttcgtcaaaattacaaagttccagatggctctcatttgataggacagtgaatatccattccttggccatcagatttattgcaggtagatcaaaagagtcatggcatttttctcactgaggcaaagacaagaaaatttcaggtagcaggagtctataacgtttctgtaatatccatgtggaatgcaagggtattgtttcatgcaagttctaaacaggttgaattagaagagagagcagggtgagaacactgagttttacgtttagcatccaatcaggtgctgtattttatattcttcatagtcatgcaaagattatgaccttgggaacatcactccattcaaacaaacttgaaggacattgagctgcgtggtttccacagacccagttcttgagaatattttatcaatttcctcacctggttcaagatgatgtcacagaacaggaaaattatacaaggccctgtcataagtgatcatttgcaagctgctgctttttaatccattgtcttgctacgccacatgctgtcggtagtgctcattcaccttatctcaaataccatcttctcagagagtctgtccctgaggaccatatcttgagtcctcctggctgcctccacacccatagcacgtggacttcactctctgttatgccctctttttctttctttaactacacttattacaaactaaattatctttatttgcttgctaatgtgttgcttgctccccaacaccacccgcccaacagaacatgagctccaggaagacacctgtctcatccaccactctccctttagtccctaactctgtgctggtctacactgagggatcaaaacatatttgtgaaatgaataaataaaatgttttaaaattcaaaagctatgtgtaaaactcttttgtgcaataaattttactaaagttaaacagctatttctgcttatgttgctctttttttttttttttttttttttttgagacagagtttctctctttcacccaggccggactgcagtggcgctatctcggctcactgcaagctctgcctcccaggttcatgccattctcctgcctcagcctcccgagtagctgggactacaggcgcccgccaccacacccagctaattttttgtatttttagtagagacggggtttcaccgtgttagccgggatggtctcgatctcctaacctcgtgatctgcctgccttggcctcccaaagtgctgggattacaggcctgagccaccatgcccggcctagtgttgctctttttttctgtttaaatttatttaggctgggtgtggtggtgcatgcctgtaatcccagcatgttgggaggcccaggcaggaggatcacttgagcccaggagtttgagactgtggtgagcaatcattgcaccactgcactccagcctgagctacagagtgagccactaacttaaaaaatatttattttattaattttatgatattttattgatgcataatagatatatagtttggggtacatgtgataatttaatgtattcatataatttgttaaaatcaaatcagtgtacttgggatatccatcacattatatgtttggcttttctttaagctataattatttcaattcttctgttttagctattttgaaatatacaatacataattgcaaaccatagtcattccactgatctgtctaccactaggtcttatttcttatctcaaattgcatatttgtacccattaaggatcttttaaagagaattctgacattcccagttatgaaaagacaatctgatttttggcctgagctgacagctcttgttgaagcctgctcattctggatcttttattcatttactgaggaatgaccaacagaagctctgaccagtgttcaaccttttgtaaattctgagcagaaaataaattgtatgaatagggcacttctttttctgttcacttataaaatcttaaagatctgtatcaatagttggtatgatgcaccgtatttaagttatacatgaagtcctacaattctaaatgaccacttcaactcctcattcctgcctctaagagtttttatttcttctacagacccagcgaactcagccccatccatactggatgggtttgaccatcgcaaagccatggctgggcagcgtgtggagctgccttgcaaagcgctcgggcaccctgagccagattaccgctggctgaaggacaacatgcccctggaactttcagggaggttccagaagaccgtgacggggctgctcattgagaacattcgcccctcggactcaggcagctatgtttgtgaagtgtccaacagatacggaactgctaaggtgataggccgcctgtacgtgaaacgtaagttggacggtaacttgcaaaggtggtgttggcttccatcgatggagctcctgttataagcaaatctccatgttttctctgtagctttccattaactcccaaaacagtccagctgagatcaacagaaacctcattttacagatgtgaaaattaatgctcagatgaattccccaaggttacacaactggagagtcttggctgtcggatttgatttgaaatctttctgatccccaaacctctgtgatttccattaggccacagactattacatttccaagatatgatttcaagataacacttcctagctgatgaattcacaacaaccagtctctctaaaaatgaacagagagagagggtaggattgttctttcagcacaagtgatggtagccaatcaaagcagttgtcctttgtctgtttccagaccatttctccattaaatttctaaatgaggctattatcacccaaagtacggggctcaaacatacccaaatattagacttgtgcctagtattatagatcatctactccaaatataatggatttatttgatcttctattgattgccttggctgccttgaggaatgtgttcagaaggatactgaaggcagatttggaggaaggagggatgtgatcgcagggtcacaatctaatctactcaaccaccctcaattttgctcttgcagaaaccaaattaaagtgaattacccaagatcacatggccagaaaagggaggcagagcattggtcagagaggaggtcttagttgccaatataatgctccttttttgaaaatatatttttatttgatgaactaaattgaacaaatttaaccacaagaatctcacagtgacaatagaagtgttttcttacttcctcctccccacccagccctaaccctgtttatggaactttctcttcagtgtcaacctgagtgtagactgccttagcgcaacaccagcctaagagaatatatttatattaaatatccaaatgactctctatctggaacaggctgtccagcctgaatcctgcaaatatttgaatatgtttagtctgggattagaaagaaatggatgataaaatccacagtcacacttctatagctgaagaatcatgtggataaaataatgcagcattggacagccagtaagaattattcccacgggctcaaagtctcttctgtgtttaaagacctctcctagctccctgttctccattgaataaagtttatatcttaggatagtactgaaggcatctcaagcaaatctgtctggttgtatttcccattgttttgcattaaaacccacttatgactagtgttccattattggaacactaagcatgtgggagttatttacatcctactgtgcaaggtcatcaccaaggtctgattgcaaaaattcaaaaaaaattgcaacctcaggcataaatgggttaataaaaacctattcctgctaaatctaacttcttcctaatccctgcacaaacctattcctttcctgattgcaagtcacattacttatgttgcttcctccacatggaagattatttcccaatacttggttatctaacacttcccaactctcttagcctccatccacaaagatgtgttgttccccattctcctgtctccttctcaactcagagtatgttactgctttctctctaaaggcgtttatcactacctatattttaaaagcctttattcttaatgtgcttatttttatcattgttcccttcttccacatctaggtgattctccaatgcttctggaatattctctgcctcccttctgactgcttcttctaactgcagaagaaaacagcttcttcgttcctatctctcttctctattggaaggcattctcttgggctccaaattcagaactgtcttcttgtcaagctcttcccttttccttaggctctgtttcatttgtagagcttcgaattccttgcccctgaaaataagctctgaatctgtacttacagccttggcgtccttcctgaatgtcagacaagtgtgtcaaccagctttctttcagaaatttagttggcacttcaaaacaacagggtcggataccaaactgaactctccaccacctcttccttccaaatggctcttgttattattatcaacatcttcctccttctcatccctcagatgcaaacatgaaatgttgggtgccctttaagcctttcctttctacatcctgccaagtcctgccatgtcctgccaagtcatacaaactgaatctcacagttactcagctctgttctcaacctctgtcctgtcctagattggatcttaattgtacctacactagacatgtgtaatgtcttcaatgacgggttttcctcaccctaatttgtcaaaagacctatgacctagtgattccattaaaagtatgtttgtgctgggtgtgatggcttgtgtctgtagtcccagctacccaggaggctgaggcagaaagggagaggagtttcaggctacagaaactcctctgtatgattgtgccactgcactccagcctaggtgacagagcaaggccccaattctaaaaaaaaaaaaaaaaaaaaaaaaaaaagtatgacttatttgctaaacacttttgaatgccttctttagttatctttgtttaattccaaaatctcagggactctctgttgcatccaaaatgaatcagaaattctcagacatgcccctgctccctgccttaattcatgtggttcccaatctctgtgattccctctttccattctgactgatctcagttctatgcacccttgatatctgtggatttcctgctcttcccatccaccctcctccacatgtgctatgtctctaatggcccctccatcactctggttggttattacagccatttattgcctttgtcttatcaacctagaagactgagctccttgaaaacaaagtgtggtgagatgaaaagttaggaacaactggggtaaaaaaaagcttttttttcacccactttttgatggggttgtttgtttttttccttgtaaatttgtttaagttccttgtagactctggatattagaccttagtcagatggatagattgcaaaaattttctcccattctgtaggttgcctgttcattctgatagtttcttttgctgagtaagtagaagcttattagtttaattagatcccatttgtcaattttggcttttgttgcaattgcttttggtgttttagtcatgaagtctttgtccatgcatatgtcctgaatggtattgactaggttttcttctagcgtttctatggttttaggttttacatttaagtctttaatccatcttgagttaattttcgtataaggtgtaaacaaacctgtaggttcagcgcatgtatcccagaacttaaagtgaaataaataataataataataataggagaagattaccagaatggattaaaaagcaaatcttagccatctgccatctacaagagatgtttgttaatttaaaagatatatttatatgtcttctggcctccatttgcttctgctaaacaatcagaggtcattcagatctttgtttctctgtatgtcatttgccatttttgctgtctgctttaaagaatttctctttatttttcgttttccataatttgtaatatgactagacaggattttcatcagattttctctgctcagcactttctgacctttaaaaatctgtaactgtaggtctttcaccaaaaattttgttttgttttgttttgatttgccatttacctgttgattggatttggctgagttatttaagcgctctcaataactattttctgttttgtaaaatagagataacacaaaaattacaggattaggagaagactgacttaaatgatgtatgaaagatagtcgataattttatagcacaagctagctgcaccacaaatattattccatttttcttgcctgtgagtttaacctcatccttggcatatgacagatgctcagtaaatgttttctacattggattaaggttgttgaattgaaaacatagcaaggcgaggatgagagtttcttccctgtctaaatcactcagccccattttaaagaaaaactctgtttcgtggtcacaaattctaataccaacctgtttttgttttttttttcctcacaattgtgtgttattggccctgggtaaaccacatatgtcatacatgtgtgtgagaatggcccagggcaaacccaccagtgccaccttgggacaaggcaaattaggatttatatgatcaatacttaggtcactattggtagccagcatgttgcatttctttttttttttttttttttgagatggagtctcactctgtcccccaagctagagtgcagtggcgccatctcagctcactgcaagctcctcttcccaggttcacaccattctcctccctcagcctcccaagtacatgggactacaggagcccgccaccacgcccggctaattgtatttttagtagagatggggtttcactgtgttagccaggatggtctccatctcctgacctcgtgatcctcccactttggcctcacaaagtgctgggattacaggtgtgagccaccatgcctggcctgtatctcttattgtcagtggatttatatcaacatcctcacagagactcctgagaaggcagtttgaccaacattattgcatttgttgcaaagagaaataaagccagaaataaaaaatagcgaagaggatgttcccaaacaaaatgctcctctgtgaaataatgtggctgatacgaactgcatgcagtatgatagcaaaaatgtggctgataggaactgtgtggagtatgattgcaataatgtggttgataggagctgtgtggagtttgattgcaataatgtggctgataagaactgttaggagtatgattgcaataatgtggctgataggaactttatgggatatgactgcaataatgtggctgataggaactgtgtgggtatgattgcaataatgtggctgataggaaccgtatggggtatgattgcaataatgtggctgataggaactctctagggtatgattgcaataatgtggctaataggaactctctggggtatgattgcaataatgtggctgatacaaaatgtatggggtatgattgcaataatgtggctgataggaactctctggggtatgattgcaataatgtggctgataggaaccgtatggggtatgattgcaataatgtggctgataggaactgtgtggggtacgattgcaataatgtggctgataggaactgtgtggagtatgattgcaataatgtggctgatgggaactgtgtggagtatgattgcaataatgtggctgatgggaactgtgtggagtatgattgcaataatgtggctgatgggaactgtgtggagtatgattgcgtgatgcacttgctttgttgaaagtccagcctgttgtcgaaatgctatctagtgatgtttttatcttttttctctctctcttactaaaacctccagagccactgaaagccaccatcagtcccaggaaggttaaaagcagcgtgggtagccaagtttccttgtcctgcagcgtgacaggaactgaggaccaggaactctcctggtaccgcaatggtgaaatcctcaaccctggaaaaaatgtgaggatcacagggatcaaccacgaaaaccttataatggatcacatggtcaaaagtgacgggggcgcataccagtgctttgtgcgcaaggacaagctgtccgctcaagactatgtgcaggtggtccttgaaggtcagtgggcctcgtttcagggtatggctgaaaaagaacccaaacccagagcactcagaaaagaagaagacagggtgaagcagtgctgatcgctcagttctaggctctctgtctcaccagctagtactctaccctaatttttcaagctaaatcaggcaaatgggagagaaagttctgacgaaaataaaattgtttcatattagaagtaatgtaaagtaacataaatgttgcccacttgtgcattagaagttatctgccagggtttaaatcttagaagaaacttgacacttaacagttttgttgattattcatctctagaccagggtctttcaagaatgccttgcttggggaatttttttttttttttttttgagatggagtttcacacttgctgcccaggctggagtgcagtggcacagtctcagctcatcacaacctctgcctcccgggttcaagcaattctcctgcctcagcctcccgagtagctgggattacaggcatgcaccaccacacctggctaattttgtatttttagtagagatggggtttctccatgttggtcaggctggtctccaatttctgaccaggtgatctgcccgcctcggccccccaaagtgctgggattacaggcatcttgggaaacttttttatgtgttataggatctttggcagcatctctggcccctttccactagatgtatgctaggagcaccttcctccaagttgttacaaccaaaaatgtctccagacattgccaggtgtttgctgggtggggtgggggcaatagcctccagtggagaagtacaacttcagattgaaaatgcagagcaaaatgtcagtacagtggttggtagaatgaaaatatggcatctgtttggtgcagttgtccctagttccatccaaatgttctcagatttaagtaaatgaaatttgtgaggaattattttgtggtataataacaggttttggatatgtgatacgatttgcttttttttaactggttactgcatactaaatcttaaagcttatcagtcagccagagaaagaagctatcacaggcaacatatatttatcactacctgattgaactagcttctatctatgtatttgtgtgtcttgttggaaattatgtccatatataatttaaaattcatctgatatcaattgattaaaataataaaatgattttgatatagcctaaagggagtacaaagaaaacacactaatatgtgaaagtaagtttaaatatatcttgattataagaccatatttctgtcattcttttttaaccttagctaattttttaagaagtagcaggtttagcaatgagattcctattttgattcaatcgtttcattgcagacagtgagatttttaaagcagaggtgaaattagctgaaggcatggtattcatattaaatgcctgacactgtgttccgtataataattaagtgcagaaagtaatcaatttgtgcagaaccagtttgctaatgatgatgcactctagtccttacatagtcactatttttagattctttgtagaaaaaggagaaattacctgtctaggcccagttaccccggcaaccatttggtgcaactaagaaaacctaaagaccatattgatgatccataacgatgtcagaagagttcaggttatcagagtgacagcaagaaagatttcaaagacactcaggtctccctgggaaaataatgtctgctttcatctccaaaagagcctgtcacttgaactaaaaagggggccgaggcgcaccgccagcacactcgcagatttatttgtcgcatgtcagcttccattcaggacaagaagcttcacttttttttttctctcttctgagagatgacagtgctaatgtagcaaagaaagcagaaatggaattacaaatacatatctagtacctgctttaaaagagtgtctggctaatttcctctggaaaacaaaaacactcccattattctcactgaaatagcgatggattaaagtaaaattataaaaatttgcaatactgtgaactaggactgaggatagatacaatggagaatctgagaatatttcctatgaggctataaaatggaatttaataattataagttcaggataaaaccataatacctgaaaaatggaatgattttaaaaaagaataataaaagtttccagttctgggaatggtaaaatagcatatatcagcctaactcccaagatgataaaaacaagaaactttgggaaaagcaaaagtatatatagacatttgagagacaccaaaatcaagttggggagtgtcctcttccactgaggacacatctgaactccaaaaatggggagtgagaatacaaatgtgcaataaaaatgagacatacaaaaaacaggactctgcacccaaaggacaaaagacaaagcaaacgatagaaacaaatcatgagaggacccagatgttagaactggcaaacaaggactttacagatgctatttaaaatatgttcaataacttacaggaaaatatggactgaaagagtgaacgtatgggaaagaccaacagagaaattgaaactgtagaaaacagtctgtagaaatgaaaaaaaatcaccatatttgtttaatacaagattagagaaggaagaagaaagtatcagtgaacttgaagataaatcttagaaaattattcaatctgaagcatggagagaaagaagactgcaaagaaaatgattagagcttcagtgacaagtaggacatcatcagataacgtgacacacacatatgactagaggcccagaaaaataggagatacggaatgcagaagaaaaaagtattcagagataatgaccttagttttatcgactttggtataaaagtaaggttgcagatctaagaaactcagcaaactccaaaaataaacacaaagaaaattctatgtcagtacatcagagttaagctgctgaaaaccgaagataaagagaaaaacttaaaaatctgagggaggaaaaatattacataatgaggacatcaataacaaatggtagatgattcatcggatattttggaggacaggagacaatggagcaacatctttaaaatgttgaaaagaaaacgaaaaacaaagacacagccctgccaacgcagacttctgtagcaaaaaacccaacaacaacaggctttaaaaattaaggaaaaataaagatattttcagtaataaagaggtgaaagaatataatgtcagcagccctgcacattaataaatgataaatgaagtcatgccggatatagagaatggacatttatatctacaggatatagataacatggaacagaaatggaacataaaatggagacatatctataagaacaaataccatgagaaatggtaaatatattagtaaatatttagcaaaattgtgttttcttttttaatttctttaaacaattgatgattataacattataaaattaccacacttggccatgtgctgtcgctcacgcctgtaatcccagcattttaggaagccgagacaggcggctcactcgaggtcaggagtttgagaccagcctggccaacatggcaaaatcctgtctctgctaaaaatacaaaaactagccaggtgtggtggcatgtgcctgtaatcccagctacaggcagaggcaggagaacagcttgaacccaggaggtggaggttgcagtgagccgagatcctgctactgcactccagcctgggtgacagagtgagactccatctctaaaaataaaataaaataaaataaataaaatgaaataaaataataaaataaaaaataaaataaaatgaaataaaataataataaataaaataaagtaaaataaaataacactttattatagagtaaatataatagatgtaataacacaaagggcagaattatttgttgcagggttcttacatttcacataaagtactgcaatcttaacttttagcagagataatttaaaacatatacacacacattgatatacatatagattgtgtgtgtgtgtgtgtaaatcaattggagcttatcttataatgcaagattggaagaacattaaaaatctaatccgtgtaagtcactatgttaatagaataagggagcaaatccaattgattatctcaatatatacagaaaaaatcatttgatgaaacttgcatccattcagcataaagaatttctagcaaactgagactctagagagcttccttgacctaatgagtggcatcctgaacaatctacagctaaaatcatacttcctggttaaacactaaatgtttttcatttaagattgagaccaaatcaaggatgcccacatccaccacttccattcaacattatactagcagccctagttaggcttgagtagaaataaaatggatggagtttggaaaggaaaaatttcagctgtcttaattacaggcattgttgtttacaaagaatatgccaagaaaacaataaagcaatttctaaaagagagtttaaaaagtcattggatataagaatgatacacaaaatgcaattttatttctatatactcagaacaaacaattggaaactaatattttgaaactttcatttacaataacataaaacataagataggaatatattttaaacaaacgtgaaagatttcaacatacaaaaatacaaaactctgctaatataaaattgaaataacctaaaaaattgaaaagatataccatattcaaggattagaaaactaaatattcctaagttaacaattctctctaaaacgattaatgtgatttcaagcaaaactgaggcatggtggcttgtgcctgtaatcctagccctttgggaggctgaggcccttagcccaggagtttgaggccagcctgggaaacatggcaaaactttgtctctacaaaaaaaaaaaaaaaaaaaaaaggcgtggtgtgcacctgcagtcccagctacttgggagattgtgccacaccaaggacaacagagggagagagacactgtctcaaaaaaaaaaaaaaaatatatatatatatatatatatacacacacacacacacatatacacatactatatgtaccttttcaacaaattaacactgaaacaactcaataaatgtatggcaaaaaaatgagtattaatccctacatcacacttcatatccacacaaaattaagttgctatccgtatagaattgaatataaagtataaagcaacacagtctccaaaagaaaacagaataattcttcatgatttgcgaataggtgacgatttcttaggacacagaaagcattaaatgtcaacacaaatacattattaagaaaagaaaaaggcaaccacagactgggataaaatattttatacacacacaaatatatgtgtcatatatatgttgacagatattatatataatctctataggaatcttacaaatgtatcagatcattataagatatctgacatagatactatatatatatttccttgtatttcaattgttgtattccacaacaaatcaaaaacaaaaaggcaaacagtctaatataacaatggccaaagatttgagcagacacccactaaaggaaacacacggatggccaataggcacataaaacacgtgccttccacggtatttctgggaaaaatatacaacctgcgtttagtcatgaggaaatatgagacaaacccaatttcagcaactgactacaaaattactcttcaaaaatgtaaaagtcaagaaacacaaaagaggctgaagaatgttccagatgaaaagaggctgaaatgacatgaaacataaataatgggtgatacggactgctctggaaaaaaaacagtgacgagggatattagcggtcaatggacagaattttgctgtggacagtgagttagataatagtactgttccaaagttacatcttctaattatattctaagtgtactctgattatgatgatatatatgcacatataaagcgtgcatactctattattatgtttcttctaagctcaagcacaggcaaaaccagcacatcctaagaggaatcagagcagtgatctctgttggatgtggatttattgaaaggagcacttaaggaattttggtaatggaaatgttttatatcttgatcgtttttgtggttactctggtgtgtatatatttagcaaaactaagctgtacacttaagatctgtatatttcactgtatgtaaaatttacctacaaaaagagaagtataactgaagaacatttttctaaacacttgagttttcagagcttaatgtaaaaaccagtgaaaagaaatctacagctaaacacattttacaaaaaccatggaattataaaggacacgtgaaataactccagtactcctaagtattaatgactgatcatggacaatgaatagcaatcatgatgacatctaacttctctgtaaaattaaacacaggatgtgatgaggcaacgtctgcagtgcgttaaagacaaaagcatcaatttttcattttaatattttaaagttgtctttttcatctctgatagtaagagacaaaatgcttacaacccaaggacactgcaatatgctacttatgagcatagcctggaggaaacaaactccagggacttctccagccacctgaaacatgagctggaatgaagaagtgagattcaggaatttggaaaggagtagggggtggagggaagagctgcagcacagccccatcaccatgaagaccctacataactggcctccctgaccaagaactaggccccaaggttctgggggaatgagtggcactttcctcaaaggtgtctggtactattaaccattaactgtcacctttccctgatggaattgcaagctatcctaattttgcttgcctcctttctttttgtttataatactttccaattttcaacaaaaaagatattcaacaatggagattcattacttttataataaaatcaaaaactaaaaaaaatctactcattcttatctttcattatgggacaaccctttaattgaacacaaaaattcttttaaaaaacaaaagatgtcccctccagcaaggtctcttaccagactcagaaatcctgtggcatgtgattgcaattatgtcaaaatgacccacttatgcctagaaaaaatgtgtcacagtgttgatttgtatgcctgaggctggctgacctattggtaacttttcttctgattttcatacatttcctttaatatgcatgtatttctttttataaatggaaaaacatatataaaagaaacatgcatttgtaactattactatataagagaaaaaaccatatggatgatagaaaaataatggaatatgaaaatttgatctatgtaaacatactgaaaatttctatggagacttctctaagattaagatcctagtttgcctgcgatagttctgggtcatgcctgttctcttggcataattattagtcctttctgtttcagcctcaaaagtgtcccaggttggatgttaaattatatggccagcctacttaagatacttttagagagatttaaaacatgcttaagtaccctacttaagatatctttagaggtttttaatacacggcatttaatacaaactttatttagcttctacccattctcagagacttcatggaagtttgcatgcaattactatttgtaattaaagttattaaaagaggatttcttatgagaaaatgatgaagatgaggtcatcaatctctcagtagtttcctttattcctgtaaagaattccctagtgagaaaaccccaaataacttgaggaagtattaggttggtgcaaaagtaattgctgtttttgccattactttttgcaatcacttttgcaccaacctaacagataaagtgactgtttgtgggagtgagcgggtgtggattttccgtctgtttataactttgtgtgaggaaacaccagttttaaattaaggacttcttaggagctgtcattgtttaacctgaacatctgagttgtattaccattcctcttaagtcaatcaggaaatatagaaacagttgatgaaagcttgctaacactgtgcttacctgttttgaaaacagtgaactcttgttctgattaacgttttgctttatcaggaaaaccagacctttttggtaatgtttaacaactacgacatttaccccctagacatgaaagacatatacttggaagttgtttaattatttgtatgtgccactttcttccataatttgttttcctgcagatggaactcccaaaattatttctgcctttagtgaaaaggtggtgagtccagcagagccggtttcccttatgtgcaacgtgaagggaacacctttgcccacgatcacgtggaccctggacgatgacccgattctcaagggtggcagtcaccgcatcagccagatgatcacgtcggaggggaacgtggtcagctacctgaacatctccagctcccaggtccgggacgggggagtctaccgctgcactgccaacaactcggcgggagtcgtcctgtaccaggctcgaataaacgtaagaggtgcttgtcaaatcagctcctcaaaaaaacacacataactcattatagtggagaagaagatttctgcatgcaccgagctgggtcttggaatgccagagcggattaactgttgcttcccatttcctaccctctccttcctactcaggaatggcactgactgggttaatgttggaaatggcattttggtttctgtagtcagcttgttcttttttactctagatctgttcacctgatgtttcctttcctggtttatgctctgcatgccctttcccttctccttctcttcggttcttccacattcatggtaaaccttcatgtacatggtattaaacttacattcatgctgcaacgtgatgtaacctccattgtcgtcctagattttacagagagagttaaacaattgatcaattgctgccagtgtgttcaccaaaagtgcgtgattgtccagtatagactagttactttctattaattaaattgccttttatcttgtaatttttaattcaaaacattttcatagaagtagcagataaagtgtttcacagttatacatttgaatttaagaaaaggaaagaaaaacctttgttgtagaaaatgccacatgcaaaaatatttgtttaactgaaaaagatgtgcttacatgaatataatctacatttttaactcaaggaaaagtgtacccatttccctacatgagatgtacccttaaattattttcaagagtttctttgtgtctctccagggcctgcaagcattcgaccaatgaaaaacatcacagcaatagcaggacgggacacatacattcactgtcgtgtgattggctatccgtattactccattaaatggtacaagaactctaacctgcttcctttcaaccaccgccaagtggcatttgagaacaatggaactcttaaactttcagatgtgcaaaaggaagtggacgagggggagtacacgtgcaacgtgttggttcaaccacaactctccaccagccagagcgtccacgtgaccgtgaaaggtaagccctgttctcctggttcccacacaactcattccatagcccgactacttcccagaccaatgatttgaagtcgggtaatccaagatctgcttatttagagcaggataattgtacaggctgaagaatgacagggaacatgagatgtcctctttactactgactgaatcttcacaggaactttagttgatctgattttctctccaggtggaattttggcttggttttccagagggcatgtgttgttaacaatacaacagaaaaaaaaggagcacatcattagcttcattatctagtcatctctcagataatttttaaataaataaccttcttttcctaaaacctcctaaaagcaaggtctcttagaacttcactggaagggattttctgtattggatgaggatttcaaacaaacgtcttatcttctgtagatgagcaggtcaaagcaacaacatagaaattatatgtttaaaggatgccacagaacgttttcctcattaaattattctttgcatcatgacatggactgtcatggaatctacctgtcaggatgatctttagagatcctgcaatttgaattgactacaatctccttaccagaaaaaaacaataaggtgatcagactcatccaaggatacgcagacttttagtggcagagcctcagaaagactcatttcttctattctacaagtcagtttcctgagctgaatatgaaataaaattgttttaattatgtaaggaatctacctgaggtgggtcctaggaatagaactaatatgttataaaactatttccgaaacctgtgggtgttgcttctagccacattgagctgcctgtctgaggtgtccaagttctctctccaggaaccaataagtggcttttagttgcccttgttacaaagttgcataggtttcctgtggtcttccccaagcttcttttcccaccaaccctgtgagttttacttttgtgagaacgcatacagacacacacacatggaaataataatatgtgtatactattattacggggcatatatattgcattacattatatattatagaatatgtattgtgcattgtatattagatatgcctgcacataattataaatcggtttttaataaccatatgtcttgagaatttcctcaaatcactagatattcttggtaaaccaggctgcataaaggttcatttggtggttgtgtttatttatttaatcctcatttacagaacatctgcttcatgccaggcactactctagacactgaggaatacaacaatgaaaaaggtctgcaaggtcctttccttcattgactctcttctcagtcaggagagacaaacaataaacaaataaaacaagtgaataaaccagaaaacacctaatggtactccatactatgcagagaattaaaacatggcagtatcttaatggttcattgcaatagtcagatgccatatcaacacattttctgtactctgtcatcttaaaattcattggtctatcatacccttggaaggaatgttttacccacacatgattttgtaacataaaaagttgatcatttggaaatgattggttcactgtgttacacagatcttccaaatgttgatacaatttgttatacaatatcaaaatatcacaactactaacattaccatgatctcatcagaaagtcttcaagtaaactgtcaagttcatgctgatggatgcaagttttctaaaattctattctttcttgaaagattcaattttattatttataataaacaccatcaattgtaattgtaggagtgatgggctcatttatctgtaagaaattgtttgacaaatagaaaagaccgcataaccatcgtttttaggtagccattcttttaagaaagaaatggaattccatgaagaaaagcagctggtcgaatttgcaactcaagcaagcacagacatactctgcttgaaaatagccgtgctgctcaggaggtggaggaaacactgtgccttcttcccattttattacacaggacatagaacattaaaaataacgtgagctttagggtaaagatgtaataaaactgttatgtttcctgcttcgtcaagtgtctgtaagtgaatctggcatttttaaaaaaccaactcacagtatgcatcggtaaacagtacaatgaatagtcatcctgttagtgtccctgctgggattcatggtaacgcccagcagtctcacccaccatggcttttgctccaacagtgcaaatgtcaacaccatgagaaaggcaaacagcacctcagcattgtcatgaaaacgattttcttcttacagatcacctaaaattgtctcagggatccctacaggtctgtgagctacattttgaaaacatctaatacagtgctaaaattttagtttatttttaatgtttgaccattacaaatgaggcatcaaatgaacttctttatgcattggcctttgtctgattttaagattatttctttcgagaaaaatttccagaagtatgaccattggataaataggtataatactttaatgtaatttttaggagacatagatttaaacgaaagccctttgaatcattaacatttattctttaaatttgccagatcagtataaatgaatgtattcatcttaatccttttgaagtgacagaaaccaactcaaactagcttatggccaaaagaataatttattgtctcttataaacaatatatttatgattttaggaaataattctattgaataattttttcttcaggagcttcttttcttctgaatacttatcatatagtataaaacttgtcagctcctttgcaagtacttgcaaacaaaagaaggaaaatattattttatgtggtattttattgcctggagagaaatggcagttgttgggatttggggcttgccaaatttttcagaatagtcgggaaaagctgcctggaaaaagtgagattttgagcaaagatgtgaaggggttcaagacagctcatggatacctggggaagggacatcctaggtaaagggaagagatacaaccacggtgtctagagtttgcctggcaagcttgaggaataacagagaggctggtgtggtgggagccaagtgaacaagaaaacactaaaaggccctgagtcagaaggagcagaaccttttcacgggggacttactagatcaggacttcggttttcaggacgtggggttttctgctgagtgagatgggggctttattggatgactttaaacagaaaagtcacatggccagactaaggttttaaaaggatgcttttagccaggcaaggtgggacgagcccgtagtcccagatactccagaggctgagacaggagaatacttccagtctagtagtttgaggttgtggttgtggtgcactatatttgcacctgtgaatagacactgcactccagcctgggcaacatagtgagaccccatctctaaaaagaagaaggacgcatctgattcctgtgctgagaatggtctattcggggaaagggggcaagtagaatgacctgttggaaagtgaatccaggtgagagatgatggtggcttggaccagggggagagcagaggaggttgggggtagaagacagactccggatctatttcgaaggtctattcagtcggttttcctagtggttggatacaggtgtgaggaaaataaagacatcaaggatcaggtcaggcttctggcctgaatatcaggaagaatggcattgctttctactgagtcagcagaagatgcagtggagccgtttgaggaaggcgattaggagtctagttatcgatgtgttgaggttgaaatacacactaaacaaagaagtggatgctgtcagtaggaaattagatatgggagagtagagttcaggaatccaggctgcagatctggtgacatcagtgaatagatgatgttcaacaccaaggcctgaacaggaccctcaggggactttgtgcactacaccgcagattttaacttcatatgtacaggcttccccagcccccagtcaggctcacattagaacccttcaccaaatatctgaaaataaagtctgacaaaaattcaaacaaggactgtttgaaatgtaagtttacctatttttagatttcccagattggcacagatccatgtattgactatgaccccattggttgcaaggtgcgagaacccaaattacctttgcttaagcagccaggtgcagaggctcactgctgtaatcccagctacttgggaggcctaggtgtgatgtggtacgcacctgtagctccagctactccggagactcaggcagaagaatggcttgaggccaggagtgcaagactgtggtgaactacttccaaaacacagtaacagttttacaccattcgcaatcttagcctttactcagaacttagaagggtcttaaataaaatgacttctgaacatttaagtttacattttaaaatattttaacctcagcactttgggagaccgaggcaggaggatcacttgaggccaggagtttgagatcagcctggccaacgtggcaaaacctggtctctactaaaaatacaaaaattagccaggcatggtggcacacacctgtaatcctagatactcaggtggctgaggagggaggatggcttgaacccaggaggcggagtttgcagtgagccaagatagcaccactgcactccatcctgggtgacagggaagactctgtctcaatcaatcaatcgatcgatcagtaaaatgtttttaaatgaaatattaatatataaagtaaattatactccaatggtcaggattgtagtttatcaaggctttttaaaaattaacctttactattttcagttaccaagtattaggggagggagataagaaattagctaaattttaggaaaagacttagaattttggctttccctgtggattaggattgaaagagactttcttattttgttcatgtaaatgcagctccactacttttcctgggagaccacacagtgaatatttcagccagctaattttggaagagcaaacctgaagccttaaaaattggcttccttgggaagtggaagtggcccacttgatcccggcaataatgctgctaacagggaaaccaaattattgttatcttgtccccaggaggttcgttttaaatactggatatagcggaaagtgtgtgcatatgtgtttagatgatatttggaaacaatactattttttcatcatgtcttttcctggcaatagtcataaccctttgcttattttggagcatatgcctgcaattttttttatttcaaagattgatataaataatatgcttattattgatggtggttgaagcttaagcagttctgaaatatatgtaactatccagaagtgcaagtttgctgccttcaaacatataggcagaagtaaaagtcaaagtcccttctttcacttcatttcaacttaacaagcagttttatatttaacacattttcaagctttgtctttcccattttaggtgccacattgaacttgaacggtgcttaattgcgtgttctaattgctggggatcaacactgccaggaaagttaattggctgctggataaaaatgtcaccttttatttatatttatataaaactttatagtttacaaaacactttcatctgtgtcaccttaattaatacagtgactctgtaacgtagataaagcataatcagggaaagaatagaagagagatgaggctgcgcacagtcacccagtaatacattcaagactcaaacgcagatgttttgattccaacacaacccgtggtgactctcagaagaataattcgtattgcagcgggaagccagggtaggagtggggagaaatgaatacaaagaacccaggaataaagctatttaaaaagtcaagacagacaacatgttaaaatgtagggcaaaagatattgagggactaatttaagagagatagcatttgttaaattggagagaggaaaaggagagaatggatttggtgaaagagggcaggtcagaacaagaaaggactccagaagctcttgcttgggagatggagaggctgagaggagcgatgtggcacctgagtgtcttggcgaaagcctttggatggcggggttggtcttaagtgcctgtggatcaccattctggcttcagaccatggggatttaaaaaaatagacaggaaagcaaactaaaattcatagagaagggtagttaaaatcacaggtaaataaatgtctaagaagcaccaagctttcagagtcatattttatgaggatttttaaaagtgaatgtttgccaatagtgagatgaaatggccatgctaggaatgcagagaacaacagaaacattcgcttttacatatttcattccatttctatatttgtggcgatttctcattttaatgtaccagcatttttttaccatgtcctccttcaaattgaagggagaattagatgtcactgccagggttttcagctcttgtgttggtggtactttgtgtactgtagcccaacagggacactgttctgcacattttgacgttaaaatcctgcttccctgcagctttttgtcctgtgctgtgtctcgtctgtcaccgtaatgtcttgctgtattgctgttggtgcaagtggggaaatgaatgctgagttaaaaataatgctgtgagtgtgtctgctcgccttccactcgaggtgagcggccggggatgccgtcttctaatgacatcattcttcaaaggctgggaacaaatgtcatctcgcctaggtggagggacagctttgtgcacagaaacagccttggcagtttccccactcctgctttcagacatttgctcattagctgttccaaccttggcactatcagcttccactgaattccaaacccaactctgttggcaaggaaaggtctttcattcttaatctgtcactttcttccactttctcctactatctctctagatactggagttacttgcaatattgtttatggaaaggacagcattttgagtttatttttccattttagttcctcattaaagtggagcaatggttaacttaagctccagtttgctggggtcttttgtgtgtggccatacactgcagtcatccacatattttcatatttatttttcaacaacgacttgggaattgcagagcttctattatgaataatacacgagaaatatagacctggggaaaaatagaatggtaacgtattaaatgtataatccttttatgttaatttattatttaaaatgagaatttatactctctttttaatttaataccctaatgtgagaaaagaaagctaatgaagtgggaactttcactgtcctccctttttaaatgacgcaagaaagcactcatgcttcaatatacttaaatggatgcattggctcagctaccctgggggtttatgctctcaagtgtctgcagaagagaggtaggatatcaaaattgagtgcaggactcagcttctatgggttccttcagacaggtttgtcctggaggtggaatgacttaaaattcctctattctagaaatcgaagcagacacctttctttaaaatatggcattttattaagtgttttataagcgatatctcaaattactttaccctaattggagggaaaaaaagactatgtgtaagattggtttcattatgaaagaatgctatatatatatatatgtataatatatatttattatataatacatatataaatatatgcataatttattatatataaatatatgcatataatataataaatatataatttattatatataaatatatgcatataatataataaatatattttgatatatataaatatatgcataaatatatgttatgtattgcatatattacattacatattgattttaaatgtatatacatgattttttacattgtaaataaaataatatgtatttacattttaaataaagtgatacgtatttcctgtgtatagtataatgttttgaaatatatatccattgtggaatgactaaatctgatcaaataacatataggttgtctcacatagttatcatgtttgtggtaagaacactttacattcactgtaaacatttttcaagaatacaataaattattagctacagtcaccatgttgtacaatagatctcttggacttttcctcctgaaattttgtgtcctttgacacacacctccccagtaactccagcccttgggaaccaccattctcctttctacttctataagatcaacctttttagattgcatatatgagttagatgatgtggtatttgcctttatgtgcctggcttatttcacttaatataatgttctccaggttcatccatattgtcacaaaggactacagctcactctttcttaaggttgaatagtcttaaggctgaaggtccttattttattttttatttttattatttatttatttatttatttatttatttatttatttatttatttagagacggagtctcactctgtggccaggctggagtgcagtggcgcgatctcggctcactgcatcctctgcctcctgggttcaagtgattctcctgcctcagcctcccaagtagctgggactacaggcgtgcaccactatgcccagctaatttttgtatttttagtggagacaagccttcgccatattgaccaggatggtctcaatctcttgacctcgtgatctgcctgcctcggcctcccaaagtgcagggattacagttgttttattttaacttgtccctttttttggcaaccattgtgtatgtataccatatattttttaatccattcatctgctggtgaccatttagccacttgaatccatatcttggctattgtaaacaatgccacaatgaacatggaagtgtagatatctcttcaacacactgatttcatatccttttcatgtatacccagtaatgggattgctagaaaatatggtggttctatttttaatgttttgaggaacctccatactattttctatagtgagtataataacttgcattcctatcaatacagtacaaagcttctcttttctccacatgttcaccgatgcttgtttttttcatgttttttataatagccattctaacatgtgtgagatgataacctcattttggttttagtttgcatttccctgataattagcgatgttgagcattttttatatacctgttagccatgtatgtcttcttttgagaaatgtttattcaggttcattgcccattttttaatattcattcaatttgcctattttcaaatcaggttgttttcttgctattgcattgtttgaatcctttatatattttggatagtaaccttttatcagatgtacggtttgcaaatatattctttccttctatatataggttgtcacttcattcactctggtgattgattcctttgctgtgcagaagtttttttagtttgatgtaatcccattgttctatttttgcgtttgttgtccatgcttttggggtaataaccaaaagtcactgcccagagcaatgttaggagatttttccctatgttttctcctagtagtgtcatagtttaggcccttccatttaagtcttaaatccagtttgagtttaattgtgtatatggcattagagacatcataaattaaagttaatgatctaattccatttttctgcttgtgggtatctagtttccccaacaccatttactgaaaagaccccattgtgtgctcttggctcctttgttaaaaatcagtttgctgtaaatgtgtggatttaccattctggtccattggtctatgattttatggaagtacaatgctgtttggttattatagctcagtagtatattttgaagtcatgtggtgtgatgcctctagctttgttctttttcctcaagattgttttggctattctggctcttttttggttatattggaattttaggatttttttttctatttctgtgaaaaatgtcattggtattttggtagaaagtacattgactctgtaggtcacttcaggtaagatgggcattttaacaacatgaattcttctcatccatgaacacaagttatgtttccatttatttctgtctttctcaacttctttcaccaatgttttatacttatcactgtagagatctttcacctccttggttaatttattcataagtattttagtttttgtagctattgtaaatgagattgttttctttaatttttttcagatagttcactattagtgtatacaaacactactgatttttgccttgtagctttatcatatgattatttcaataggtgtagaaaaatacttgacaaaatttaacatcctttcatgataaatattctcaacaatttagatacagaaggaatgttcctcaacataataaaggccatacatgacaaacctacagctaacattgtactcgagacaagttggaagcttttccttaagattctgaacaaaaaaaaaaagatgcacactcttgccacttccattcaacatgtcactggaagtctcagccaaagcaattaggcaagagaaagaaatacaaggcattcagataattcaaattggaaaggaagaaattaacttgtttgcaaatgacatgaccatatatatagaaaaccctaagacactaccaaaaaggattagaagtaataaaccaattcagtaaagttgcaggatacaaaatcaacatataagaatacaattcttttatttagttaaaattgcaagataaattatgttttataatacttgttgcacttgctgaacatgggaaacttagagaaggagagaattatgtagagataagaaagggaaaagaatgccaagcaaattactaacacttttgctgtctaattcataattaatctgcaaatacacacacgtttgtgcacacaccacagggaaaaactctttggcagtgctaaaaataatgccgtgataatgacattttaagtcagaaataacaactctcaattattcagaaccatgcggtaggatcttttatatgcattgactcaaaacacatgtaaattgtttaaatatataaattcaataaaattgtgtacttcatacacctatataacatttatatgcattatattttaaatataaagatatataaatataaaacacaaatataaatatacatatagttatatatgtatattatatataagtacatatatatgtggttacagatatatagatgcatgatacaattatagactcttagaatcttagggctataaatcagcttgaagttcatctagaccagcctcccatgtgatattcaacatgcccctggactgtaccccacatttttctagactcttcctgcacgatctgtgcagtggttcactaagctctcagccctttctgtttctacatggctgtgattgtcagacagttcttcctctgtctgacatacatacaaatagagatacatacaaatatgccttctctagctcttctcttctttctggttcgaatattccctctagagcaacactaaatagttccccgtttctccacataaagctcccagtcgtgcaaaagactaagctttgtcttcctggctaaccatctctagcgtccccatttgtttaaatactttgtatgcaacgaagttcagcagctcctttcctttgaaggacacactgatgtgtctattttgtctcaatgaaacatagccctctgggcattttctaatgaataaaagaggggaatgagagtgccacctctgtcctgaagacaagaacgcctagttgcagcccatgtcccactgttgagccatggtttgggactcatgaacaaaaatcccaatggtgaattttgtttttgttttgtcaacttttggctgacaccacaccattatcatctgtccatgcaagatccttattttgttttattttaacttgtccccccttttttcaaccatccaccaattctggtatcgtttgtccctgtctcataggcacagacttatgtgtacttaatatatttattttaaattaattttctggcatccttatttagacatgcatgtaaatatatacaataacagcacaaaagtgaatgcttagtttgccccccacccagccctttgactctgtacaaatactaccatgggtatcttataaatgtgtccatgtgtagtattaatattactagagggccagtagtagaattgttaggtcatagaatttaacttcactaataattgcatagccactctccaaaattcctataccagtttactttaccaccagctatgcattagaggtcccagttccccgcatcctggtacctgtgtttctatttgtgacaaagctgattgatgtaaaggagctctttgttttaatttgttttcttttcattactattgtgcttgaatgtctttttatactctcaggagatgtctgaggatttcatctatgcattgctttgtgcatttgctatcactcctgctacttcttcctgctttgctgtagttctttagtataaatatgaatctcttattacttagaaatgattgtgaatatcttttccaaggctgtcttttctctcttaactttgcctttgtcttcatttggaccttgtttaagaaatttatgagctcatgaagatgcattcctatttttttctgtatttgttctatgtctctatttttgctgtttgcatttaggccttcaacccacactgagcttcacagatatagtaaagctggggtccaatatattttctatctatatcgagtcagttatcccaatatttattaaatgacccatgttttcttctcctctccatctaccaagataccatgatggtgctgtcagaggcagtcttagttctgtgaaatatattgactacctttttatacccttgtctcactgtaacatatttcagcactttacttaaaaaaaagcctcttcaagtcagttattattaaccaagcttctaaagagctatgaccttttctaagccaacgtcatgaaaaatacttctcaagcaaataatctattactaacaatccttgtaaaaaaactaattggaaaaataagccaagttttaaaatgaataccagtgattttatgaatcttgtttacttttgttattaagcctggttgtcgtcacctctggttggggtcacatggctttgcttccatcagaagtccatataaacaaaaataaaataattgtacctcatctagatgacacttttctctaactaaataagtaaaacatgagatatgtttcattttcttgatgccttgatgattcaaatggcttttcttttcatattaaaaatgcagaaaagtaactcagttttattacagtcttctgtatgaaggtattattgctctcaaccaggggaaacataacctgtcatcctgctcagaccatggtgactctaattgtttacatatagatattatcataagtttttaagttcttggtcgttttaatcttttaaagaaactatttcaacataatatgattatggctttacaatacactccataaaaataactttcaagagatgtttcatatgattgaagactcaaatggccccaagaaattatccagttctttccaccacattcccctttaggcatctggttgacaatattgcagggcatccattttttttggaagtgcattggaaggagacactgccatgcttctcagagtttgttttactcttttacgcccccaaatttcaagtagtttattttttccctttattgtatccaacttgcatcttttgtgtttctctttattataattctactttatgccttgggatatctttttcttgttcctaaaacattttaattatttttttcctcccatggacttacttgataattttaaacaatttttgggaaaaaagttatttgccttccttttatttccttttctctctctctcttttttttttcttttttttttttttttttttttttttttgagacagagtttcactcttgttgcccaggctggagtgtaatggcacaatatcggctcactgcaatctctgcttcctgggttcaagcaattctctacctcagcctcccaagtaactgggattacaggggtgagccaccatgcccagctaatttttgtatttttagcagagatggggtttcactatgttggccaggctggcctcaaactcctgacctcagatgatccgcccacctcagcctcccaaagtgctgggattacaggcgtgagccactgcacccagcccccttacttcgttgttatatttatgactctttacctcttttcacagtctagcagtctaaaataagcatcctatagaagaactactttgtttaaaatcattgtagaaaagttagctactcttattcctgatatattccaattattagagagaaaaactgaatttttgctcagaacactagctaaacttgggccagctgaatgagcaaaaacaacaaaacaaacacagcattttttttaagttagtgagcaacaattttaaaattcaccttttaaacgttttcccttgcttctttttttattcttcttctatcttttccttgttctgagggaaaataacaagatacttttcatcatgtatagaggggtatatttgaaagagaactcagcactaattctcttctagtcccagtcccagatgagttaaagtaatgtgaatggatggttgaagtatatggagagtgtgtcacacacagacctggttttgttattaatggtgcatgcatttttgctgtagatgaaacaaaccattgtggttgggtttttcgggaagctgactctgagatggatgctagtgtgaagagtgtttatcaaggagtgccttatgatcaacaaccgaggagggaaggacaggaagaaggactgggcgaagaaagagtgagctgggatgcaggccaatgacagtgagctctggagcaagaacagtccttcagggttgtcctgagtttgggcagaattgctcctcaatcagtcactagattgaggacactccaaaaaagagcctgtccttgggtgaagtgggcctctgcagctgagacaatctccgaggtggccaataacttccagatgacatcaccccatgaattggtggtaacatgtcctttcttgaaaggaatctggtcagtgcaactcctcccacttacgtagatgtcaaatggctatacatgtgggtcttaaacaccttttcctaaacacattttttcattcatttgcgcccactggccgggcgtggtggctcacgcctgtaatcccagcactttgggaggccgaggcgggtaaatcaactgaggtcaggagtttgagaccagcctggctaacatggtgaaaccctgtctctaccaaaaatacaaaaattagccaggtgtaatggcgggcacctgtagtaccagctactcgggagtctgaggcaggagaattgattgaacctgggaggcggaggttgccatgagccgagatcatgccactgcactccagcctgggcaacaagatgggaaacaagaatctgtctccaaaaaaaaaaaaattgctcccgctttctataatgacatgagtccaatatttcaaattagaaatgagaaatattacagtgtaccatagtgtattgtgttgtagttcatagctcaattggacctttgtcatcagaacaagtttcaactcaaaaaatctctttagttttgtgagtgctaagatgttttttaaaaatgtattcaggtaatacttgtgcgtctgctgttaatgagatcaagtaataataggatggtcactgccagcaaggtgttggggtctgtgggagaacccacagacaaatgatggcaacacacgacaggaagcagcaaatgtcctgggcgaggggcagcagaaggtccaaaacagcagccatgacacctggcgcaggagaacagcagggagacaaagaagacaaatgcagacatcaacacaataccatcagagaaatatgcagtatgtgttttaggagcagaggaagtggacatttatctaattctgggcatagggtaggctgagaagtcttgaggagccaaaaaagaatgtccaagaaaagctgagttgaatctcaaaagggtctagcgcctgaaacggtttccaaaagcagaaacaattgagtgtagttttgccattataagatgatcagagtgagaatggggctcggacagggtgtggggacagaggtgggtcaggtgcagttgctcacatgtaagagcccctatggctgacacaaaggatactcccagtaagcgaaggtctgcatctgcacagagaggaccaggcctcggagagttagcacatcctgctgaatcctaaaggtgttggagcagaggtaaatgctcgcagcaatgttttagaaacattaatctggttgaggtgggtaaggtatatcacagtgcagaaagatgaaaaaaaaaaaaaaaagaatgaccagttaggacacaattgaaagagttgtaattaaaaaggtgatagtactgtgtttggaaaaagagaaaccacacaaaagacatgttgagaattggagtagacaatacatagcagcacactctcagcagctggacacaaaaagaaatgcacaactaggaacgcttttattattcgaagcttcttgcaaccaaaatattttgctatcactactaagaacagagaattgaagaagcttagattaaggggaaacttgctatgtttggtttgggatttgagatacttctgagacatcaagatgaagatattgacatactactgaacaagcaggcatgaatcttgagaaggagtttttgtttgaaaatttagattaggagtcaacagcattgagctgacagctggggcaaaggaggtgctgagaccatcagggagagagaaggaagaacaaggccaggtcaggacactgaggaacaatggttccattagcgtatgattagtaagagacattcctttccatctgaattgttgaactatttattcatggttttcaatctcataattcaattttgtaatgtgtagtatgattcttcaaatgaatgtgatatccaccctcattaacttttgccatgggatctatgaactctcataaactcttgtagggtacttatctatcttttagacatttaaagtaaatacacataaatgaacagagatggtgactgatagggtttggctgtgtctccacccaaatctcatcttgaattttactcccataattcccacgtgttgtgggagggatctggtgggagataattgaatcatgggggcagtttcctcatactgttctcgtggtagtgaataagtcttatgagatctgatggttttatcagggatttccgcttttgcgtcttcctcattctctttgcctgatgccatccatgtaaggtgggacttgcttctccttgctttctgccatgattgtgaggctcccccagccacgtggacctgtaagtccaattaaactctttcttttgtaaattgcccagtcttggatatgtctttatccacagcatgaaaatggactaacacagtgacaaaatttattattttaaagaatatattactggcccatttaattaacttagaaataatttcaaatcatatttactataaaaaaattgtgtgatacaattctaataatggaacaaagctaacactgcaatggccatattagaatctttattgtgtaaaataaagaataattctatataggaaaaacaatatgcattatgaaataataccaggaaataaaataattcaatccactgtttaaaattacaatataatatgaggaaagatttttatcacatcagtaactatagcggacataatgttcttctattttatttcatttaattttaagttccaaggtacatgtgcaggatgtacaagtttgtcacataggtaaatgtgtgccatggtggtatgctgcacctctcaacccatcacctaggtattaagcccagcatgcattagctatttttcctgatgctttccctccccttacccatgctttcacatgctttcttcctctccctgtgtccatgagttctcattgttcaactcccgcttataagtgagaacatgcagtgtttggttttctgttcctgcattagtttgtggaagataatggcttccagctccatccatgtccctgcaaaggacatgatctcattcctttctatggctgcaaagtattccatggggtatttttaccacctttaatctcttggtgcccactctgagtgagaattgtgaaatttggcctgcatgatttagttgttagtatggctgtggtcaaaaagtcaaaagataacaagtgttggcaaggctgtgtggagaaaatggaaccccgtacagtgttggtggggatgtaaattagtgtagacatgataggaaacaataggaagtttcctaaaaaaatttatataatccagtaattccactactgggtgtatatccagaggaaatgaaatcactctgtgaagggggtacctgtgatcccacgttcatggcagcactatccacgacagccaagacatggaaacaacttaagtgtccattggtagatgaatggataaagagaatgtcacacacacatacacacacacacacatgcacacacgaacattatttagcctttcttgtttgttttctccaagtcacagcaggttcagtgccttgacactttctgaaactaaggaagacatggatgattgggtccagctatttttttctgtccatggggaacatgttttcttagaatggagaatgtggccagagaaaactttggtctgctgtttttacttataactcctcccctaaaggaggtatacttctcatttgagtacaccttaaataattcaaaagatgtaaatttatcaaaatatactcaaaactcctacttcattcatccacagaaattcaaatgtggtatttcaaatctatgtctagagaaaaacagatacttgaaacattttttaaagttttgtatgatttgggctattacaaatatgcccaagacacagttctttaaggaaaccttaaagatagatcctaaaagtcatctccaccacactgcaaggacaatgccttgtccttccctgtccttcccacccagaaggcagggccaaagaattccccactggctcactcttgcctttttcgcctaggtcaatgtcagttaatatcagctcatattgaaccccgcggggagcttggagtgagaggctaagaagggaaactaatggaatctaagttgatgtgacccacgcagcctctggtttcttttagcacccaccggctccagcaatatccttatcactccctcatcatatgtctctgcatcttggcctcctgcccttcctgctaaagcaggtgcaggtcacgggaccagcagcctaagtcacggtaagctaggtgcatctctggctgctgctggttggaagtcaccgatctcagggaaacaaactcacatagcaattcagagttggcgcgaggaccgtacctaaataaacaaggccagatattgactcaagctccccaactggccctgccagcagaggggagagttggcacagtagttagaagtcctcggcccctaggctaataagactatgaagaggagcttcactcttgtccctgccatgtcgtcattattaagtcctggaagtgtctgcctgctcctcttttctaagtcattcttttttttttttttaattatactttaagttttagggtacatgtgcacaatgtacacgttagttacacatgtatacatgtgccatgctggtgtgctgcacccattaacttgtcatttagcattaggtatatctcctaatgctatccgtcccccctccccccaccccacaacagtacccagaatgtgatgttccccttgctgtgtccatgtgttctcattgttcaattcccatctatgagtgagaacatgcggtgtttggttttttgtccttgcgacaatgatagactggattaagaaaatgtggcacatatacaccatggaatactatacagccataaaaaatgatgagttcatgtcctttgtagggacatggatgaaattggaaatcatcattctcagtaaactaagtcattcttaatgacttcaggattgtctaaagtgcagagtgtaaacatatgttcatcatcacctctgaaagtttttttctaaaaaacattattcaatcaaaatgaacaagacatccaggctcggtggctcacgcctataatcccagcactttgggaggccaaggcaggtggatcacatgaggtcaggagttcgagaccagcctggccaacatggtgaaaccccgtctctactaaaaatacaaaaaaaattagccaagcctagtggcgtgtgcctgtaatcccagctacttgggaggctgaggcaggagaatcacttgagcccgggaggtggaggttgcagtgaggcgagatcatgccactgaactccagcctaggcaacaagagtgaaaactccgtttaaaaaagaaaaagaaagaaaagaaaaaaaaagaacaggacactatttatcccactagttgtgggaaataaaaaagataaacttgatagatctcctgccctcctgggtcactctacttaagaaaatgggcacgtccataaatcactgtactcacttgagtcatcaatgtgataaattccatacaagagttttgaacaagagtgagtagaggaaccgcttacttgtgttgtatgtacattgtggagaactgtatcagactgggtcagtaatctaaaatttagctaaacgatgttgttaagtagcagaattgaccagataaccagacttatgggtgaggagatcttgaaggtataccccggactagaaactcccacctgctcacagcctcatcatttcggagtcacgccttgcactgaactggacagtaaatagccctgtggctgcgcagaagagctacttgctgtctatttcaatgcaagctgataatgaactgtgtttcattatcacctcgttacacatgaagagatagaatcgcagagctaaataaactggatcaagataacactgctaatcacccagaattgacgagcaccccacccatgattttatcaaagtcttatacgcctcttctctaggagaaatcaaagcatttccctccatgaagaagaatatacaattaatttttaagagacaagacagaaatatatcagtctgatctaatattcttgttaagggtttagatagagtaagagtcaaaattgacatttggcagtattcaatggctctgagctgcctaggaaaaggacccccgccattatgtagagtgaaatacacaagcctggtaataaatgacctttatcagatatttacgtacttcttgtagaaagggtatgtcaaaagcggtgtgtgtcatattcaggatttctgctcctatgatatacaagcttttactgtcagcaagattcagataatttaccttatttaggtgatatcatgaatcaggtaatcagtgtgtctcaaataggaggttcagctttcccaaaatcatgagaagagttttctaatcactggagttactttgtgccatcgatcttatgtcttatgaatataaaatataaggcttaagacgctttaaaaattttatgcatttgtatgcagcagacttgcaactcacagctgatgcaagcaaggcaacttaagcagtgaagaaagaattgacatgattgacaaataggtcttgtgatttaatttacattaacaatgatgtaatgtgcatactgacctaatgtgtccttacataatgtggcaagcaaagcaacacatagcaaacctaattttgacattcttctgggaaaacgcttttccttatgactaaacttttctttaatatttattttaaccattttggaaaggcttttttttggtagatatgttttaaaatattttaaatgtatctttttatttaatatgttaaccgtgacttataattcagaatgctaattaagtattacgattttgtattaattacaaaaatgctgactactaagggcaatgtgctcccaaacaaaatgtcatccaactactgtgtgtgttgcgtttttgtgtctgttctttataatttacttttagtttctcaccctcctccttttgcttgccaattgtggcttcttactaagccctcttcaatatgcctgaactcccagaatctgatttaggccaagatatcagataactgacagtgttgtaatgatttaaaataagatgttcaaagcaagggattatccttggagtgatgtgtatgagatttagtgcattagctttctgacactggtttttcagtgctttggaagtgtacttcttgattttcagccctgttgctttgtactaaagtaatgataaaaatattccttaaataccatacactgatgaattgcaaatattttggaattatagaaaacacagggttttggttttcgttttggttttaatgctgattcttctatagctacctcttacttctgttcttgaaaatttgtatgtgcatatatttcctgtattctataactctcttatgctctaaagggacattctaatactttacaattatttacaacctacactctatgttttccttttttttttttgagacggagtttcgctctgtctcccatgctggagtgcagtgacatgaccttggctcactgcaacctcagcctcccgggttcaagcaattctcctgcctcagcctccctagtagctgggactataggtgcacgccaccatgcctggctaattttttttttttatttttagtagaaacaaggtttttccatgttggccaggctgctcacgaactcctgacctctggtgatttgcccacctgggcctcccaaagtgttgggattacaggcgtgagccaccacacccggccttcttattaaatagctagattaaaaaatatgctatgtcttacctttctttcttgatttggagaaagtaaatcctcacgtattccttctccctgttgtaactgatagagaaaattagcccagtaacctttcaacttacctgttttttcctcatcttaaaggcttgtgaaatagaacaaatgctaagaaactgattcagatacacaactaagtttgagaattactgtgttaactcattcagagctcaaggcagcactctattttataaataaggaaactgagaccctgagaggggttaagtaactgtagtaagtagcatagctgaacttaaaccaaagtagcctggctccaaagttcttatcttagaaaaattgtctgtaattcagacagtaagcaccaagccaaggtttgtctgagtatgctgacaaccaggtttttgtgtccaggaaatcaaaggggaggaaatgtaattattttctttaataaagcatagcaatttagtattaataatatttacatatatagtgagcatttatgccacttgggggcaagagatttaaagaaatacaagcacctttggtacaacatgacattttctccagcacattccaactgagaacgttcatacctcagtctgacccgattctctccaccagcactggatagaatctcatcctgagacctttatctcttagcatcagatcagcccttttcaatcccaaagatctaactttacatggagaatccacaggaggattgacattgagtatgcttgtcggtacctttgaccatttaaaaaaattaatttccctggtaaaacctaacttgagctacctacttcttcgacctctggctgtacttgcaattttgagttctagctcccaactgcttttgaaagcagacagccgtcatagtgataatacgaaataagagaagcgccatggctgcacttccttgctgtctgcggcctatggctatatatggaagctccactggcagaggctgatgggttatgctcattgctgtgtgcccagcacgttcactgctgccacacacatcccaggtgctcaataaacatgacttgattgaatgaacaaataaatgaatgaatggttttctattcaaatttctcagccggatcccttacctcttccttaagctgatagttgaaatggacttacaattgttgaataaactgtagaaatctttaataacttcattaggaaaaactcgtaatataataattggtttatattagattatcacatgattaatcatcttagtttgtactcttagtcatttccaagcccctgcatacaaataaacctttttctttccaagaatgtatgcaaaaacacaaaaaaggcttacattacaggctctgatattagttatattgacatgatttaagccctccgagaatagttaactagttctaagaccaaaagggcaaggtaacatctttgagtatcacttttcccatctgcaaagtaaagcaataaataactaatccgtaaggctgatgaaagagcatattactttgctcataactaacaagtaacagttagagttcaaatgtggttcatctgactccattttaactatttcagaatgttaataccctatgacatcatctaggagggcactgaggaagagagttcctaaggcaaggtggacaaaacaggcatcactcagcaaagctgaatcaggaaagagctttccaggctgagtttgcttgcagtgtccatggcaggccaggctgaaggctataacccgacctccttagcaatacatcagcaagtcaaataacctgccacggaccagttcacaattaaaagttacacacgtaaagtgtgcaaaactaagagatgcaaagtaaagatgtagttattctaatatgaaataagaatttataattaatggttgttattagttggacataacagagaactttaacaataaaattggaatatttattttacttttttttttttttttagttttttagacacaggctggagtcacccaggctggagtgcactggtgccctcgtagcttactgcagcctcgaactcctgggctcaagggatcctcccgccttggcctcctcagtagctgggaccagaggtgcacaccatcgcacctggctaattttttaaaaaaatgttgtagatatgggggtcccgttatgttgcccaggctagtcttgaactcctggcctcaagtgttcctcctgccttggcctcccaaagtgctgggattacaggtgtgagccaccacatccagccaaaattggaatttctgcttcttcagtgggtttagaatatgcctatttacaaggcaggaaacaattagaaggggaacagtaattgtagtgtcatagtcgcaaagtaggaaagaaacctcctcttgtatacatcattttaaaaggctttgaaggaaaaccaaacctaaatccctctttcacactatttacactacagatatagtctgaaatgttttcattcaaaaataatttttaaattaaagtttgttgaacaaaattaacttgctgaagtacaaattgaaccatggtttttatttaaaatgatgagaacattcaaataatagaagcagaatttcaaatttgctacagttcctgtatttctatgctgtatctatgatcgtctgtactaccctttcagtgccgtatacagggttaaaggaaaagcaaatgtagaataagcacagttcgttattatctttcttttttcttgcagttccgcctttcatacaaccctttgagtttccaagattctccattgggcagcgggtcttcatcccctgtgttgtggtctcaggggacttacccatcacgatcacctggcagaaggatggccggccaatccctgggagccttggggtgaccattgacaatattgacttcacgagctccttgaggatttccaatctctcgctcatgcacaatgggaattacacctgcatagcccggaatgaggccgccgctgtggagcaccaaagccagttgattgtcagaggtgagcaaaggatcatgagccatgtggcatctgtagagttgatttaacaatggtttaagatgatggggcttgaaatatttcgaaaataactggaacttagaaattcagttttatctcactaaaaaaaaaaaaaaaaaaaaaaaaaaatacgactctaaacccaaccatgaattcccctaaactccaagataaggttttatttacctaaaatatgttttaaataattaatagctaagaaggtgggaaccataggatttaattcatgaaataaggcttccgtatgctaagccaatgagttttgaggactaacgtccgtgagcttttgctttattgtattcatataatatttttagtatttcttatttcaataaatggttttttaaaaaatatgtctcaaagctatgtatcaaagtttttctaaagagccatgaaatagcttttcataatgtttgttttagttttagaaatgtggttttctttgcccatctattctatttagcattaaatctatcattattttgggacgccattgcaacgttttaaaattaagcagagtatggtagtacttattcaaaaaaattaaaatagggtaggctaacttgtagaaaactggcagtaatctcattacatctaaactgtaagcttcagtcttattttgaacttctattcaagtcaccaaattcccattaaggctcacactcttcatctatgaaataagctgctagtgttctctaatgtatatcaaacacagacattctgtgatgtttatgattctccaagagtactatacattaatctaccattacaatattcatccacattgcaaaagtaactgtctgaagttaaagatttatattaacaatgattatttgcattttaaaattccccagattgtggtcccagagtggttgttaggagggggaggatttctgtaatttcccagagagtggagatagctctttcttgagcaggagattctcatgtccttcttcattccttactccttgtccccttgatacctcttcttccttgccagctgggaagaaatgcactttttatctacctgccagcaaaaggaagtgacacagacttagaagtcataggaagaaactaactttgtatttctgaaaaaaaaaatttccaggtgaataatttagaaaatatatattcaattagacacaaacttagcagcctcatgacatttttctcatttccaccttgcactttggagtggaagaattgggatacttgattttttcccaaattttgaaagataaataaaaaagggagccaacctagtatctgtttcccaagcgttttcttataagcagagttaactcttgggtttgtgaagggcaaaatagtacatcagcctgctttctatataatctgctctgaaggatccaggccaggaatctgaaacgtcagataaaaatgtacggggatgctttttgtacaacttgcccttgcagaaaaggcaaccagaagtttttaaccaaggcaaaatcagatgagctgaaaatgagcctagctatttgggataatgtagctgatcatgatatgactgatgtctccatgtgattgttcttcaaatatgttaaataagctttagttaaattaatattaaatcaccagtgagataatgcagcctagaggaagaaaatgtgcttcacaaacaggtcagtgtgactggagaaacaggcagggacaaggtgatgtgggactgtggttctcaatccagacagttctgtagaatctcctgggaggcttaagaaaacactgatgtgcattttttggtcccaatctacaccaattaaatcataatctttaggggtaaatccatcttccagatctctggggaattgttcttttttcccaaaaatcactagttagtggttctcaaactttgttgtacattcagattgcatagggaggtctaaaaaggtcctgatgaccaggatgaagctcctgtcaattaaataaccatctttggaggtgggacccaggcatcaataatttgtaaaatccacaggtttattctaatatgtagccaagtctcagttccagccccctgagtaattagaacgtgcagccattttgaggtgtggattttcttctagattaaagagttggcactgttgactttaaccaccacagcactatggcctgattgatctttttagttgtcacactagtagctgtctgaagaatggactgggctagaaagcaagaagagtagttaacaggctatttcagacattcagacaagataaaaatgccttggatgaaggtgttaatgttaaggtcatgagaagcagtggaattcacaatctattttggcggtaaagcaaataaaacacgcttatggagtgaatgttgcaaatgagataaagaagaacctttagtggaatcatgctttgcctaataacaaggtgaatgaaagtgtctttagcagaagcagagaagaaatgaggaagaacggtattgacaaggggaataatggtcaatgatatgggagaagcacctgtcccagcagtcactagggcactccagcatttaaggccccagaataagagaaggaggaatcagcagaagagacgaagagggaaaaggagcagcctgtaaaggaggagaaaatccagtggactgtggcactctagaagcaaaatcagaaataaatcgagaaagagaatattaaacagtattgaatcctgctgaaagtagacaaagaggaaaaccaagagttggtcactggtttaggaagatggatattgtttatgaccttgatggatattgtttatgacctggtgtcattgcagcgagggcttgattagaggagcttcagaaaagaaagaaggtcaatgtgcaggaactcagaaaacacaactatttttatatttttaggaattttgctatcacaggaggcagtaaaatggagacaaagttggaaatggacatggggcaagggcaggagttatttttaagactggatactttacagcctgctttatgcttatgagaataagccagtagagaggaaaaaaatatgtgtcaagataaagaggagattattacaggatcaaagtccttgagttagtgaatgcaaccagaattctttgtaccagtgcagtagtacgttcaaagtagtataataacaaccatggtgtgaagctccagtaggtagcaccaacagaaatgattgaaaattatagggaagggggatgttttgggtcaaagaagtggaaaaacaaaaattatctaataggaccatcacagagtaacaggtaacacatttatcctcctactacaaaccaactataaaattggtctaatatatataagaactgctttcaggaacaaaacaaagtgcatgaagtcagttccaaattcaccccagatagctgcttggggtactttctgcacatgacagagagtgcagagcccaaatagatcacagtgatcttggcaggtggagaaaacagagagagaaattgaaagatactaagatgattactgggtattgaaggacaagctactggagattagggagctattcaaagaaaggtctctagaaatctgtacagggctcctttgcagtttcagctgaatactgttcttcacatgcacagggtgctagcagaagttgcacattgcttgggaatgctggagttctaactagccagaataggggaattcagccgcaatctcaggaatgccacaccctaggagtaggactaatctatccccagcataagggttactctagaccagccctaaaagagcctaagaagattcttggcaagataaaacttctccactagtaagttaattgtgtgcataaacaatatttgacactaaaaaggaagacaacaaaatccagacccccaacagcatagcgtatccacaatgtactgcattcaataaacacaggcacacctgattttatcacacttttcttttttgttgttgttgttgtgtttttttattttattttattattattctttaagttttagggtatatgtgcacaatgtgcaggttagttacatatgtatacatgtgccatgctggtgtgctgcacccatcaactcgtcatctagcattaggtatatctcctaatgctatccctcccccctcccctcatcccacaacagtccccagagtgtgatgttccccttcctgtgtccatgtgttctcattgttcaattcccacccatgagtaagaatatgcagtgtttggttttttgttcttgtgatagtttactgggaatgatgatttccaatttcatccatgtccctacaaaggacatgaactcatcattttttatggctgcatagtattccatgatgtatatgtgccacattttcttaatccagtctatcactgttggacatttgggttggtcccaagtctttgctattgtgaatagtgcctcaataaacatacgtgtgcatgtgtctttatagcagcatgatttatagtcctttgggtatatacccagtaatgggatggctgggtcaaatggtatttctagttctagatccctgaggaatcgccacactgactttcacaatggtagaactagtttacagtcccaccaacagtgtaaaagtgttcctatttctccacatcctctccagcacctgttgtttcctgactttttaacgattgccattctaactggtgtgagatggtatctcactgtggttttgatttgcatttctctgatggccagtgacggtgagcattttttcatgtgttttttggctgcataaatgtcttcttttgagaagtgtctgttcatgtcctttgcctactttttgatggggttgttttttttttcttgtaaatttgtttgagttcattgtagattctggatattagccctttgtcagatgagtaggttgcgaaaattttctcccattttgtaggttgcctgttcactctgatagtagtttcttttgctgtgcagaagctctttagtttaattagatccaaaaagaatccaggaccagatggattcacagccaaattctaccagaggtacaaggaggaactggtaccattccttctgaaattattccaatcaatagaaaaagagggaatcctccctaactcattttatgaggccagcgtcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggcttgttcaatatacgcaaattaataaatataatctagcatataacagaaccaaagacaaaaaacacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgacatgattgtatatctagaaaaccccatcgtctcagcccaaaatcttcttaagctgataagcaacttcagcaaagtctcaggatacaaaatcaatgtacaaaaatcacaagcattcttatataccaataacagacaaacagagagccaaattatgagtgaactcccattcacaattgcttcaaagagaataaaatacctaggaatccaacttacaagggatgtgaaggacctcttcaaggagaactacaaaccgctgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatgtggcacaaaaaaagagcccgcgtcgccaagtcaatcctaagccaaaagaacaaagctggaggcatcatgctacctgacttcaaactatactacaaggctacagtaaccaaaacagcatggcactggtaccaaaacagagatatagaccaatggaacagaacagagccctcagaaataacgccacatatctacaactgtctgatctttgacaaacctgagaaaaacaagcaatggggaaaggattccctatttaataaatggtgctgggaaaactggctagccatatgtagaaagctgaaactggatcccttccttacaccttatacaaaaaattaattcaagatggattaaagacttaaaccttagacctaaaaccataaaaaccctagaagaaaacctaggcattaccatttaggacataggcatgggcaaggatttcatgtctaaaacaccaaaagcaatggaaacaaaagccagaattgacaaatgggatctaattaaactaaagagcttctgcacttttcttttcttcctttttttttttttttttttgagacgggatcttgctctgtcacccaggctgcagtacaatgggccaatctccactcactgcaacctctaccttccgggttcacaccattctcctgcctcagcttcctgagtagcttggattacaggcatgtgccaacatgccaagctaatttttttatttttagtagagacaaggtttcaccacgttggccaggctggtctcgaactcctggcctcaggtgatgcaccccacttggcctcccaaagtgccgagattacaggagtgagccaccatgcccggccacactttgctttattgtgcttcccagatatcgcattttttacaagttgaaggtttgtggcaatcctgcatcgagcaagtctatggggaccattttttccaacagtgtgtgcccacttcgtgtctgtatgtcacattttggtaattcttgcaacatttgaaactttatcattattattatgtctgttatggtgattggtaatcagtaatctctggtgttactattataatgttactattataattgttcagtagccatatgagatggcaaacttaatcgataaatgttgtgtgtgttctgaccactctactaaccaaccatttcccagtctccatttctcagcttccctatttcctaagacaacaatattgaccatttctcagcttccctacttcctaagacataacaatattgaaattaggccaatgaatggccccacaacagtctccggtgtttcagtgagaggaggaatcattcattgcacatctctcactttaaatcaaaagctagaaatgattgcattcagtgaggaaggcatttgaaagccaagagaggccggaagctgggcttcctatgccaaactgtttgccacattgtaaacacaaaggaaaagttcttgagggcaatgaaaaatgctactccagtgaacacacaaatggtaaagtgaaacaacctcgttgctaatatggagaacgtttaaatagtatggatagagaaaaccaaaccagccaccacattcccttaagtacaagcttgatacagggcaaggccctaactctcttctatgaaggctgagtgacgtgaggaagctgcataagaaaagtttgacctggggtcattgtaaagcttagcacattgtttgatagcctgggttagtgggaagatttgtaaagacttgatctaaaataaattagctgttgtcttgaagaaaatataagaaaacaaaaacaacaccccaaaagcaaaaatctcttagctgttatgtatgagccaataagagccaaatctcatagctcttatgacagtggactgatggtttccctgatatcctgctcagtggagtgaccttggcattgattaaggtattagaaataacgcattaggcttcatgaaagagcactcctgccctttgcttcctgttgtggtctctagaccactcacaggaaagcaccaacacaacagttcctatctgtgattccaaaggagggccgttttctcacacttttttatatcttctgatgggtcaatggtttctggcttttaatggtgaactgccacatagagaaacaagcacattggctaaaatagttgactgtcagttgacaggaaaaatgaaaatcatagaaggttgctattttattgccatctgttgatccaatttttgatagaattctcatgctatgattttacttcattcattcattcttacacaaaatatttcttaaatatttgttttataataggtgctgttatgagtgccgaggataccatggtgattaaaataaagacaccaagtctctgcccattaaggttcaaagtctagtgaagggaagagataatgaacaaacaatgtcagttatctacaaggactatgaaaaataaacatgttgtacgtggattgagaaagatggggatgaaaatagtattttaggtaggctgggcaggggaaggctttctggagagatctttgagcagagacttgactgaagtgaaggcgtacgtcccagggaattgtaggaagcgagttccaagcagagagaccaacaagtctgaagactgagtgtggagtgagttttgtgtgttcacagcccagcaagaggcccaaggtgcctcctattaagtaagagaggacagaaagtgtaaggcagagatataagcagaggccaggccatctattctcagaatgatgggaaagcaataggtttaattgtcagtgtcgtaaattaaatcttacctagactttggccaagtcccatctcaactaaatgtcaccaagtagagaatggtggtatttatccatgcaccccctcccacctccaccaaatggctttcattaaaactgaatttctgcccaggtttacagctagggaaacctaaattcattctttggaaatatatagcaacttagaagccatggcttccaaacataaaacgctggactacatttaaaactagaaaaatgcctgtcttattataaccatagtattatttctttaaaaatgaaacaacagaagtaatccaccccccaccaacacacacaaaataagcagatcaagccaaagacctctgtgttttaaacaaccttcattttaggcaacaccaggagtaaacttcctcaaagaaacctatttgaaacttcagatactctcagcctatgtggatcccatgacaagattttggtattttggaatatatatcaaattgttctttttggggagacaggagtgctggttatgtgcacgtaattatgattcagagaagtgtttggcaagtttagccatattgcatcttggagatgtgatgtaattatgtagttgaacctattcatctctttaattactcttcctccctaccagaaaaaccgctctgtattagtccatttttatgctgctgataaagacatacccaagactggctaatttataaagaaaaagaggattaatggactcacagttccacaggtggctgggaggtgaaaggcatgtcttacatggtggcaggcaagagagagcttgtgcaggggaaatcccctttataaaatcatcagatctcatgagactcattcactatcacgagaacagcatgggaaagatccgccccccgtggttaaattacttcccactggatccctcccacaataggtgggaattgtgggagctacaattcaagatgagatttgggtggggacactaccaaaccatatcatgatctattggaaaacaaactatattggcaagccggctcaccacaatatactaaataatgtgttatactaataaaaggaaatctaaatatcatctttaaaaaaggaaaccaacaaccttggggaattatacacccagacaatatagagtactggtggtctttttgttctgtcataagttttggcccaaacggcaacagtcccaaaggcttcacatccttccatctcaggctctgtatcttcttggccagagtcctcctatgaggctgtcttctgctgtccctcagatggcacttccattgggtccactcttctcaaagacctcaggctttgggggtcaccctgatctgcgttattaacttagccatgctccgtttccctagtctataaaactgaagtaataacattcattgattcatgtgtcctttcaacgcatagttgcagagtgctttctgtactgcagatctgtgctgtgcgctgggcatgccatggcctgtgagaaaggaatggttcttgttctcatagcatgcacagcctggtatgggacacagactgttaaacagcaataccagatgagcgtaataaaggctatggtaagtaattaaggcctcagagaagcacttaatcttatccacagcatcagaaacaaatgtgcctgactgagtgagtgctaagctaagatgcaaatggtgaatgggaacttattaaacagacatgaagaagcctgtgtgaagacccagcagcaagaatggtcttggggactggataatagatggggttttagaatagttggggcaaagcctgcaagaggagaatgtcacagaatgcaactggagaccaagggctcaagtcataaaaatcctttaaaatatcccaagagtctggattataccaaagggccatgggaatatgcgatgcttttaagcaaggaagtcacatcatccaatttgtgtcttagatcctttaggtccctgagtgaagaatgaattcaagtgggacagttcgtggcaggtagaccagttagggggctgagaaatctaaataagaggcaatatgggccttgtcctaggttgggttcccttgaaagtagagtgtgaggcacagaattggctggcaggttatttatttgggatgtcattcctggatcccagaatggaaagaatgagattagaaagggagaaaagaaaatcagtaaaagttgctttaatgagctggttgctgctatgggcaactggagctcattcctactgggagccttctaaggaatcacgtagaacagtggttcttgaagtgtggtctctgtaccagcagcctcagcatcacctgggagctcattagaaaggcaaaatattggattccaccccagatgtactgagtcagaatcactggagacaaggtttagcaatgtgtggtttaatcagctcttcaggtgattctgatgccctctaatgtttgagaagcgcaggcacagagcaggcctcataattgccccactggatcggaggaaactgaggcagaggcagagaatttataccctgactcctgtccctcagtgatggacaattgtttttcacatgtcaaggttgcaccagtaaggtgggtaaaggctcatgacttctgagaaggcctgagacagcaaagagagggccgcatccccttagtgcagtgtcctggcaaagtgtgtggaggtggagctgtcctcccagaggtgctgaagccgggtggacagaggggctgtgcccctttcccacataaccagactactcactgtgactggggtgtggcagtggagatgcagagaatttgaggatacattttcaagaaataatcatcagcacctgataaaaagaaatgaaagaagaggatatgaaaggaaattccatttttcttttttgaggaccttaatggatggtgaacaggaacaggtaccattttggaaacttgaattagaggtacctgtgatataagctaatgatggaaggatatggtgctctacacaccaagggaagataaaggcaatcatcgtgatgggagtgggtgaaatagctcaggaggtttgttgagtaagatgtggagaagattgaagacaacaccctgagaagaaggagagggccacagtgggggatcctctctttaataagcaagcaaagtaagaattgtcttgagggcaattctgggaggggtcaaaggatggaactaggagtacgtgaaacccactgagtactcaggaaatgctcactttcattactaagtgactccttgtgggggctcctgattcttttaggacaatttcttaggctgccattttgtagaaaaaaagtatctaggtcgaatattaatagtttctttaaaaaatatctgcactttttaaaaaataaactgctgcttactttaaaaaattgggaactttgttgtccctagggataatggtcattctcatatgcttagagcatatgagaatgatgtcattagttacatgttaaacactgggtcctcattcagacactcccctgccctggaattttaatcttagctggtgatgcagctgtctcaaagtgatgacaacccccaggggaccatatgcctgttgtcttcacattaggctctgggcaggcaaagaaatttgtttagaaacttattactacttttcccaggaatccatcacctctaattttgccaggcagaactcaacccaagcatattcttaaggtgtcagatctgaggggtgtggcctcaggtcttcttgatgtaagtacatggatgttcccagtcttagagttcttattgtaactcacaagttcactttcatgaaagggacctacgtattcactggtacacgataataaatcacttagggattgaatatttacattcatgacagtcttctgtcaaaatttaaaggaaatgtatatgatttggcttattcatgcacttagtaaaatatagcattttcctcaaggtggtctcaagttgcatggtatatcagccaaagaccaaacatctgagctattaattattctctttgctataaaaattaagaagctcacttactgcagaagcttctttcttaggtcttcatgtgactgtaaatcactggggtatctgaagagagaattccaatctatgagcaaagaggtgtacgtgggaaatcccctggctactcctaccagggtcagaaacagttttcaatgatacggggtaattattctactaatttagggaccgtttttatctgtaactaccttatacttaccgtatttctatggttgtttctcatatacacttctttgatgagattttaaggaacatttcgttggattagaaccaaattgaggggaggagtaatggatcaattatgattagacatgcttccagagggaatgcaagagattttctaccctgtccattgatgagcaatttcttgctcttggcagaacttgagccaaatggagcacagaatgtggatggctgcagattttccttccaccctgcagagaataattttggcatggtgtcttcaactttgtcacctgctcttgagttgattggtcacttttactagaaaacttagctctaaataatctctaccatatttcttagagataatttcctcactcagagatagtcattccttattatcttattttaaatatattttcattttcttaaatacattttgtctccgaataccatctacatgaagtaacattgcttatcacttaagcaatatctcagaaacccattggctgtgtaaattatttatttcatttgcaagttgggaactttgctcatcaagaatatgtcaggccgtgcgcagtggctcacgcctgtaatcccagcactttgggaggctgaggctggtggatcacgagatcaggagttcaagaccagcctggccaagatggtaaaaccccatctctattaaaaatacaaaaaaattacctgggcgtgatggcaggcacctgtaatcccagctactcaggaggctgaggcagagaattgcttgaacctgggaggtggaagttgcagtgagcagagaacatgccactgcactccacctaggcaacagagtaagactccatctcaaaaaaaaaaaaaaaagtaaaagctaaacatacctgcatttactaaattaatcaacactcttacagcagttaatatctccacagttctgagaacttttctaatcttaatttatttgatcatcttaacaatccttaaaatgagttccataatcatctccaattttcagataagtaaattgagaccaagagccattttacagtttgcacaaaattgcccaacaggaaatagaaaagctggacaccaagccaatgtgtttaacacttggctttatgctggtagtcattattttctggtgcttcttcatgtgtaaatcattctacagaaagtaaagctagaaaattaaaagcaatattttctccagaaacactgcggtgaattccatctctggctgcttcttgtgtcttgacattttcccttcctcctttgttattttatggccaaagcgatcgtcacgttggctcagatcattgtaacaagcttctaagccccttgctaacttaggccctaaccatcttctcagtctatcatatgtggcagctgagttcctatctacctgtaacacataggctcacatttatgtctcaaaattaagaattctgtatcttgcaaggctgatgagattagccttaccaggaatttctaagtatctactatatggtgtagataattcatctcttctcacatagtttatgactgcctcactgaaagtctaccctgtaatgaatcgctgatctgctgggaaagatacggggattagaatactttcagatgctaccttttctaagagatgtgatacatattaaaatcctaatggcttatctcaaaaaatatgctttctttggggagatatgttttaagtgaaatcatgtttatgttttaggtagggatggttctttacagcacctcacaacattcaccagataagcagtcacttaatatcttgttttttataggcacactagaaaacctttatggtacttcactgcaactactctccacagtccccctttggcccaccgtggtgctgacatctggcataacggactatgtgttctcaccagaattttgggaaaagttcagtcccacattgtattctcgattgcctttacgaggtgcctgttatttctcactttatctcctggtagaggaaaaatcaacatcgaatactttgaccagttcacatccaagatgaatacttatatttgataattactatttgaggcacaaatatatatttgatctacttttttttttttttttttttttttgagatggagtttgactcttgttgcccaggctggagtgcaatggcattatctcagctcactgcaacctccgcttcccgggtccaagcaattctccagcctccgcctcctgagtagctaggattacaggcatgcgccaccacacccagctaattttgtatttttagtagagatggggtttctccgtgttggtcagactggtctcaaactccaggcctcaggtgatctgcttgcctcggactcccaaagtgttgggattacaggcatgagccaccgcgcccagcctgatctgttctttaaatggtgattctgattcaattttccattgagggaatttctgtatatttttgataacacaattaaaagcaaaatattccatccctttgatttagtcaaacttcctccctcgaggccagttttccctagttcaaagggcttttacctgtgacaaaagctcattgatatgaatcagaaaatttttcagcactgaaattactcccttaatttgtcccaaactgccaatagtgtttttattgtcccatgtgtatgaaacagtcttcatattttaatattcattaaaatgattcagtttcttagaatcatacctttactcagtttctggtctagtcttaattactggtgacatttctctcttttcagttcctcccaagtttgtggttcagccacgggaccaggacgggatttatggcaaagcagtcatcctcaattgttctgctgagggttaccctgtacctaccatcgtgtggaaattctctaaaggtatggagttacttgatctacttgttacctgtcaaacatttgctatgttctaaaggattagataagcatttctagatttccagagaagtttcttgcaagtagatacgtatctctgtttccaccaagcctatcattctctcatagacattcctagttgtccacctaggtgtttttattcagacacacaacgtgtctgttgtacataacatgcccttggaaaggccacagagggatggaagtcttttgtgtagattgtttcagcacttaggaagtcctaccttgcccacctgtattacataaccatggtctgcttagagatcactgcacactcgtacatgaagagatgtgagtttaaattgtcagaactactcatagctggaaaactatttccccagtatttagagagatgagtgggtttagaaagttaaagataatatcattgattgttttattccccttattaccttagaatatacagattacacgtcatctccttggcgtgctctttttaaaaacaaacacgcccaatgtcctattgcgattgtctcatgttccctgcttgcacccctaatcatgtttcctcttctaatgcagaacagtagctcctgggttttaggtgacattgtagatattatgcaagtagaaatgtatgacatggaaacgaagagtggaatcatgttagactttggaaaaacaatttctgttcattagggtggcttcttcagaacgcctccttaacggtacttgcaaacatattggaagttctctttcttttctcatttagacacttgaattcagtactatattagttgagggccagatatgtactggtgagatcaaataatcagtcaatcatgacctttttttttttccaataacctaagacctagtatctaggtttaattattgtgaggtatttgtatttgtgttgacttaatcatcatttatactctagatctttcttttttaaaatagcatgttgcattttctcattatggaagcaacaatgaccaaaggaaaaataaatggtacatttgttgcaaccctcctggcatctctcttttgagaaggaaggtaaagaagtggggaaggttgctagacactgtctgattgggaaaatagctaaatttttaaaagtccctgaagcaactcccctgtcacacaccacacaccacatccactgtccatgtgcaaaggacttcttcaaaaataaaatcctgttattcagagtctctgcccccatgactttttatttcctgccgtatttgaagctccattgtgcattattacatggaaacagataaacatcataaatttaatttagtttctatggaagtgcatatttgatattatggacattttccatgacatttgccttcttcaacattatttttaatgcctgtcgttatgcaggtgttctctctctccctgagggtgtttacagttttcactctcataaacactccagcaaatgaacactcctgtatgttaattcaatgcgcatatgtgtaagtgaagtgaaaaggcaccagccatatacaaggctcttactctgtactgcccaagggcacttaggccaccaacagtatgggtgggtaaatgtggcccagcatcctcaccaactagataacattttttttaaatagtctttacaacctgatggttgaaaatgccctctcattttaatttgcatacttagattgttaatgttgtttaacatgttttatcttatgttaacagaccacttctacttctcctttgggaaatttcttattcatgttacttgcacgcttatctctatgtcttatttatttggaagtgtttctacatagattaaataatactttgtctgtcttggatgttactgacattttatcccttcttaccactaacttaaaaattaggttgtaatagtagcttttttgtctttaaatttcatatccaatatcaagtcatcaaagaaaaaaattagaaattgcaattttttaaaaagttaaattccccccaataacatcactcaaagatgatcaaagataactgctgcaaacattttttgtctctagactgtcagtcctgtccccaagcaattgcatacccatagatacacattatacatttttaaaagtttgatgattgttgctggcttataatctttcttcagtcaacaatatactatgtatgtcttgccataacaacaaatatggtgcttaatatgacttttttttttctggagacagagtcttgctctgtcgcccaggctggagtgcagtggtgcgatctcagctcactgcaacctccgcctcctgggttcaagcaattcttctgcctcagcctcccaagtagtagctgggattacaggtgtacaccaccaagcctggctaatttttttgtatttttagtagagatgaggtttcaccatgttggccaggctggccttgaactccgtgactttttaatgtctgtgtaatgtttattgtagtacatcaataattacgtttatctaattactttagttaagattgagttcagccacttaaattcacaagggtttatttttctcataagaggactctggatgtcgacagctcaggactagtttgttggcttggctaagtcatcaggcacccaaactccttatgtgttaggaagagttctgcctctcctagcagcattcttcatcctcaaacgatggccaccaagctatagtgtcaacttcctttcacatttccctgtaggaggaagagcaaagggagatggctgcccctcccacacgactcacctccctttaaggtcctttccagaagtgcatcacagatcaattttgccagcatctctctggatcgctggccgggtcgcccctggctataaagggtccgtaagccatcatggacataatgtgtgttattttcctaagtcagagggggtgttggatacctggcaactggatatctccaacactattgttgaatgtcatatttttggtttttgccagtttttcttttagaaaaatatcgtaatgggccaagtgcagtggctcacacctgtaatcccagcactttgggaggccaaggcaggcggatcatgaggtcaggagatcaagaccatcctggctaacacggtgaaaccccgtctctactaaaaatgcaaaaaaattagccacgcgtggtggcggccacctgtagtcccagctactcaggaggctaagaatggcatgaacccgggaggcggagcttacagtgagctgagatcacgccactgcactccagcctgtgcaacagagcgagactccatctcaaaaaaaaaaggaaaagaaagatatcataatgacttctaatgacttctgtcacatttatctttgtatatgtgttcatttatccctggggataaatttctataagtagagttgctggctcaaggagtaaataatttttataactttcaatatgtattgacaatttgccagcattttattcatttacacaactcacctcagtttgcagtagtgtctgtctcttataaccaaaataatactggatattaggctttttttttttgacattttccaatctgatagagaaatatggtatattgttattttaattatgcaagcagtaaatctatttcttaagaacaatttagccttgcttatggaacatgttttctttcaatgaaatgatcactaagagctgaagtgcagctccctcataaatgacaaaactgtataaacaaaacagattcagcttgtttccttgagagatgcaacagtttaattcaggggaggcagaattccagggtaaatcactgcagtttaaaggtagctattgtagaaatgaaacaatctttgctacaaaaaaaaaaaaaaaaaaaaagtcattacatttttgaccttgggtctagatacacaaagtctgagacattcagttctcttttttgatttatttatttacatgaacaaatgaggcctcttgcctaaaagagatttaaaaaaaaaaaatcagggcttcattctgaggtgggtctcacctgtactcccagaagtccacagcttaatgccattctcttgcatgtatgtcacttatactggagggaaaatagttcagggccatctccttgttacctgctgagaagcgaagagggactgcaaatgcgagagaatagatgatgcatcagcctggggcctggcctgggcctcctttgctctctctggctgtccatagagtctctgaccttcagggaaacttggttgtgggaatgtccaaaaagaagagtcagagcatgcctggggggtgacgctggaggacaatggggagtagtttgcatttaaaatagcattgtcaaaataccccaggagtagggaaagtctgaggaaagacttaaagacagatgagtcctgtgctcctgtcctccgagggagaccggaaggtgaggggccagctagttcccaagagttgggggtagggggcgaggccgggaggttgatgcctggaatgatccagaaacaccaaggaggacattacagctgtggcagagttagtgaaaggaagtcctgggagaggagactcctgcactgggtccccatcagtcattgtaaggacctggctctgcccaagtggggagtgggtatggtgagcaatgagagtggtgatggtgatgcggtctcttcagctgctgctgtgctgaagccagaagctaggaggctagctgggtaattggagagagatggtgtgatctgcctcatgctttaaaaggatcacactggcatgctgttttgaaagcagactgtgtgaaggacaggaatttcagccggagagctgttctaaggccttggccgggatgtggccggaaccagggtgactgcagtggaggagggacaaatggattctgaatgtctttgagtgatggacatactatgggtgtgacaaaaggggagaaccccaggcagtgaggatagtggaagtgccggtgacagacaggacgactccaggagggcagacctgtggctggggtaagatcagggttttgggctcctctctatgcagatacagctgtcaatttccaatataagcaatgataaattttctaaatatcctagattttgatgaatattttctgcattgtcagagcttagaccctctatgttctgttctgcagccatatgcccaacttttgcaattgccagttctgtgttagattgattttgtgctcagtatgagttatttggacatagtgaagaatattccaacctctttctggtttgcaatggtttgttccttgcctttttacacccaaaggacagatattggcggctcacactgtctccttggagggagcacagactgcctgatttccctgtagaaggaacttaatctttttggttctgtgcaccaaagagctgactttgaagtctggtagtttattttctttttttatttttgtgatggagtctcgctctgttgcccaggctggagtgcagtggcacgatcttggctcgctgcaacctccacctcccgggttcaagagattcttctgcctcagcctcccaagcagctgggactatagccatgcactaccatgcccagctaatttttgtattttgggtagagatggggtttcaccatattggccaggctggtcttgaactcctgacctcgtgatccacccaactcggtctcccaaagtgctgggattacagacgtgagccaccgcacctgccctgaagtctggtaaatttttagtctataatttggtgttttccatttggggtcaattttcccatagatgtggtgcatctatttaatatgtagattcaggttattttaaaaaatatttttcccatgaattgtatctctaagtgttctcttccctgctttaattttcttcttcagggtctctgattgtggttccataggattgccacctagtctctgtagctgtcattttctctctggttttttaactcattgatttccattttaatttgttcgatatttttccatttctgttctccatgtcttttccccagcaaggtctgttcttctttgtgccaactccggttctgccttcactgctgtgagtttatattttttctccttctttctctccagctctgccagctcacagttcacccttcttcagccatggctttatagacaagtgactgttttattcacagtcttcatctaagtcgtaatacctggtttcttgttctgtttttttcttctattttgcttattgtatctttgctaggtcttggtttcctttcgaatacagcagccccaagacccccaggggatgactgaaccttggggagcaccaaaccctacatatactatgcgctttcctacacatgcatacccctgataaagtttaatttataaatcaggcacagtaagagattgacaaaaattatgagtactagaataaaattattattacaatgtactgtaataaaagctatgtgaatgtgctgtctctgtctctctcaacatatcttatgtgtctatactcccctattttaagactgtaattgacctcaggtagcttaaaccatggaaagtgaaaatgtggatgagggggaactactgtacttacatttgaagaaaatccatgtccccagaaaaagattgttgtgtacaaatgcctgattcctcagctaaccctacttctaaaattctaagccacatcaggcctggggaagtgccacccacacccacctatgcacactgttttcactgatggaggcttggctctcacctgtgacccactctgctgggacttctgaagttcacagcggtggccctgattccctcatcttcctgcatgctcttctgctcaattaccctgttggttgcccatttacccattctgtagctggaagtttagctattttctaatttcataggaaatagaggttacatttttctaggcttctctctcccatttgctttcatgttgttcccaggaagagaagaagtgctggtttatgcctccatcttcaaatatgaaattctattgtttatatacaaagggtcattaaatttggacttgattttagtaaaataaataaagtaggaatctaggaggaggagtagaaatcatcagttaggagactgggctataagttcaaaccccagccataatacaaccctgtctggttgggtgactgcatgtaaattacctaccccatatgaaccacagcatccttgcagctgaaacagataaaataaggggataaatgtgatgatttagtaagatgactcatagaaagcatttattatggcttctggcacatagccattagtcagtatgtattagctattattaatatcattattgccattatcatgaacttacatggttagccatttgtcctaaaaccatttattgaagagcccaaactttttcatttgcgataccttattgtctaaggggaaaatgtgaatactggagtctgtgtttcagccttctctctgttacactcaattgcctgttcagcaccatacgtattagaagtttatctccttctattttaatgtctgttttgacaatactccccttgtgacttttatttttcaaaaatgtccttgctttttctgcatggatttttgtttgtttgttccttctagatgcatattaagataactttatcaagtttccaaaaaatctggaaaatttggaggatcataaatttaaagcttaacgtgaagaatgctgatgtcattagaatattgagtcttcccagccaataccatggatagtcctttcatgtatccaagtttttcttttatgaacattaataattttattgcattctttccatttgtcagtggtagtgaatttttataagctacggcatctggttttcttttgtcctccttggttttctgggcggaaaggggtcaagagctgtctacagccaatctttgttgagcttgtccttatgtagctgtccacatctctttcttctcccagcaagggtaatgctgttcttaatttagaggagtttctattttccccactctgtagctcatactaagggctgcaatggtgtgtgactctatttcttcctgtctctcttgagattgtatttctccctgccccttttcctgtgtcctttctgctcattgtagtttccccaattccatatttccctggaggctccagagaatccaccattatttggtgcacacacaggtttgctttagctcctccttctcctactgcacccagacaagctgctggaggctgtcacttctgcactcaccacgcacagtcccccagagggcctggctgtcccttaccactagggccctaaaagcaccctcttctgctcagtgtcagcccacctggagaaatcctcccctgtggttatagactcatcacagggggcaacaggaacttgattcttttgttgagagattcatagaaataaaactaggcactccagacagttaactaaacgtttccatgcaagatggaggggaaaacacatgctgtgctcaatactggccaaactgctcaggtgaccctctctggagtcccctcctactttaggggcatgccctggaaaggctcaccttgatcctgcccacaacttccctcccaatgtccaggggacatccctggaaccttctgtagtcctcatggcctatgtctcagaagaccatgagaaatatgagggaaaggacaagcctaagtccctcaagcaggttaattctagagcagattttctgccaacaccagtttcagacctctctggtgagatgaccaagtcagtcccttcctcagcagtcaagagagggctcacactgcagatcacctgttaatcacactgtgatcacactgcacatcatactgcagatcacactgcagaagaccctgcagatcacactgtggatcacactgtggatcatgctgcagatcatgctgcagaccaccttgagatcacactgtggatcataccgtggatgacattgcagatcacctgcagatcacactgcagatcacactgtgatcacactgcagatcacaccgcagatacctgcagatcatactgcagatcacactgtggatcacactgcaatcacactgcagatcacaccatggatcacactgcagatcacaacgtggatcatactgcagatcatgcttcagatccacctgtggatcacactgcagatcacaccttggatcacactgcagatacctgcagatcatactgcagatcacaccatggatcacactgcagatacctgcagatcatactgcagatcacgcttcagatccacctgtggatcacactgcagatcacaccatggatcacactgtggatcacactgcagatgacactgcagatcacactgaggatcacctgtggatcacactgctgaacacactgcaggttgtacattcaaaagataagtctggaaagaagcaaattatcaagagacagaaatttgcttaaataaaattctcttttgtttttcctctgggaaagcagggggtttatattaaaatagctcaatagggagcacgttcatagggcccagttgggatgatactgagttttcaggtcctccaaggcttctccccaagttctggtccctttgtcctgctctgtatgcccttgcatgtttcactctgcgccagcctcgtgcctgagtgcccccaggttcagtgtccaaggcatttcgtctcattctttttttgcccttgctgccactcactctgaccttgaatgccagttccacaggctttgctcagacaagtgtctcttttgcatccctgttctgagaaattgggtctctgcattgtctctgacccttgtcttggtcatctccttgggaccagtggctccaatcctggccctatcttaatcctcttagtgtggatcaccagaataaaacttctgaccacaagcctgacctggtggaggctgctgccctcccactgtcccacccctgcctgtgcatctgcacactattcagtgctctcaccatgcccattcctagactcaccatttgtcttgctctgtgttgtttagagcaccccaagactccacacccatggttttgacctcttccatgtccttcatttcctgaagcagcagtgatcccctgctctgccccagtgcactcctctgatccaggctatcaagtcctggctctcacccagcaccccgatttccaattaggtgataagatgcaaatattgaattaatatggggaaagaattcaaataatccaaaaacgagaagaaggcaacatctctctatggcacacatggtaaaaataaacccaagttcaaagtccgatatggatccctcatgcacaacaaaaggagctctgcttgtgtgttgtgtgttccccaagaagagacaaggggcctcacaaagaaataatgagttcttgaaaacaagttgtaagctgaacagagaaagtgagtgttccatatattgttttattttcttcctttgatggtaggaaaaaccttagcagagcagaaaacctgccttcctctgtgctaccctaatcagcatctcagtggccctgggagctgctgcaggacctctgcagggtcctcacctaaggaagtgtaattaccctgagccttggtggagccaccaggacagtcaaccctggggcccatcttgctcttcctttctttatttttcagcactcctccatctttccccctcatttatttcctgggaaactttctggaagccttcttctaggtgtaggcagtcacactgaagacaaatgtttggggggctcttgctccagggaaacggtggctggagaccttgaatggtagacactgctgcagggctcctcccaggagcaaggcaaagcactggtggaatctgcataattgagtcacctcaaccacttccaatatcacatgaccccttgacgagtgctgaattgtgttcagttcatggatcaattatctgataagtgagtgaagggccaattccctctggctgatttaaaaaaaaaggattcttatgtattagttacataattacgtattagttacagaattagacattgaagtgctagtggactagcaagttgtaacaaatcctgattagacactaatctagaccatgaaatttccattgttgtcattggatagccttcttcaacatagaaatgaaggtattaaggaaagatgactggattgcacagtggacacaattatgtgcacatttacaaaagaagtaacctggacggtgtcacacctggatggtgtggtgtgttatcaagaagggatttaataaagggaattaggggcatgcaaaatcctttgaagcgtggacaaactgcgcggccctttaagcacctgagaagtgtaggaactaagatgcttctcccgtcactgctaacagctgcttctagtgctcaagcagtgatttgtagttctcccacaggcagccataaacctgatgtttggggttgacccatgcatcaatttgctgcttctaaagcaaaataatggcttttccacccttgcacctacaaaattgtttttaagtgcctctcactggtaaaatgtaaaccagaatctagtaacaaagccagggaatgtagttttcaggctttcaagccctgcaatttagggcagagtttagagggaaagtggtagtgctaaagatcaacatacagcatctgacacaaactttcagtgtcataaatattacctgcacagtggtggaagcttctttctcagggattggaaatagctctccagcctggaaccaagccagtggtgtctcaggactatacctctgtccacttcgggattcttctttgtaacagaactcttcagcactccttcactgaataagcattgtatttcagctactaaaccttatttaggtgcaactgctgttgctattcttgctttttctcttatctttccattgcaacctctatctttttacccaatgctttcctgcaatcccccaactattctcagagaggaaaccccccttcctaaagaagaaaaacaaatgcattcttgaggaaaacaccactctctccataaggatgaaagggattgtgtttgattccttggtgaaaagaaagaacagcttaccgcctgaccattgtgcaaaccattggtgaggctaaagagacctcctttccatggtcctgcgactcttcagtcttatttcaccctacaaggggacccctctggatgagctcattgaccaagctctccttgcatgcaggcatttatacccacattcatacaatcttgcttcactttatgtgcacaacaatcctacatcatatgtaaatggattattctccttattcatatatgatgaaattaaggatgcagagaaaataagccacttgctgtaaggcatgggtagtttcagagagcatgagaacctaacccttttgactcttatccaagtgccctctctacagaccagcaaagacttaacagtgaaggaaaaaaattgaaacaattttcttatttgctgctgccttcaaagtgggctcatttggtgacaatctgccgttctttttccactgtccccatactctcagtccctgtgaacacagctatgcatatatttgcaataaataagaaaggtgacccagaattaatataactagcaattcagtatgtgccttacataatgctttaacattttattttcatgtaacggagcattgaaattgtccccacttgacccctgctagccacagaaaattggcagtgttttaattaatgactgctggttaccacattgtatcttctagctaattacctaaagtgcttaccttgtgctaagaagattacaggattttacatattgatgctttgggttaaattttactctttagaataaagatgaatctaaagtagatgactgataaataattctgtcaaaccctggcgaagtctacttccctccaattaaacaaatgctagcccttggaactgtagtcctcatagtagatgaatcagttggcagtgtgttcactattattccatttagtaaccacaattagatcttcagatgcaataacccttcaacttaggttcatttttctgatgaagaaaagatttaatgttttcttaaatgcatttgaaactttatttctatcttcattaggaccttttagtaataaagaaacttacttcagtctagataggaataaacagatcatccttttctgctatttaattgagacgacttagcattgtagttaattttatgttgtgattctttaatataaatgtttcaacaattacaagcatttttctggtgaaaattatttaagaaaaggaaaacaatgtgttgttgacatggatattcatgtaaatttttcaaaccacaccagcatgttatttgattttcagtttcttaaatacagttttatataatttgaaatttttagattacctatcttttttttttttttttttttttttttttttgagacagagtctcgctctttcgcccaggctggactgcagtggcgctgtcttggctcactgcaagctctgcctcccgggttcaggccattctcctgcctcagcctccctagtagctgggactacaggcgcccgctaccacgcccggctaattttttttttgtatttttagtagagacggggtttcaccgtgttagctaggatggtctcgacctcctgacctcgtgatccacccgcctcggcctcccaaagtgctgggattacaggcgtgagccaccgcgcccggcctagattacctatcttatagttatattttttcaatcctatatttggttgagttttcaggttgtgtgtattggactaaatctattctcaatttacagtcaactttgggaacgacattaatagcctttactgattttcaaagtgtgttacaaatttaagcacttaaataaaagttgaaggctttttccttaattttaacttccaataaatctattatcctcacactaatgaacacaatatccacaagaagtaatttgataatttataaaagccaaattctttaaaaatgcagtctaattttataggagaaaaaaatgattatctcaatatatggttaaaaactagctgataatattcaacatcctcttctgattgaagcaacgagaacaaaaaaagagttttgtaaaataattacatagaaacacttccttataacccaaagtgctttggaaaatgaagaaaaagacaaaagctcagtagaaaaatgggtaagggataaatgggctgtttactaaagaacaaatacagatggccaatacattcatgatgctcaaaattatctataaacagaaacaaacaaaaatacaaaaaaaatccgccaaaatgtgcaaattaaaatagtgatgtatagcattgatgcagatttaaaagtttaatagcatacatgtatgaggaaaaaattaaccctcagctagcactgaaggagataacgtttgtacatttttaaggcagtttattgtaaatatggtaatatattttaagatttgaatatgcatcacctttggtccgaaattcttctccctgaattaagcatacagattgcctaccgctatatatatatatttctctccactgatgcactgattgatgagtggagacattcattgcaacgtggtccctattcttgtggaatgggaaagacagacagccatataatcttaaaattattaaataattaaaaagagaatgttagaaagcacaacaatgttgtttgcttactataagccataccaatacatagttcaagaacttcagtgcttctaccatcccataatgaaggttctattattatttccattttacaagttaagaagctgaaatattatgtaacttacctaattttacacgttaggaatctattgctttgtaacaaattaccccaatttagtggcttaagatagtatacatttaatagcttccatttctgtaggtctggaatgcatgtgtggcttagctgagacctctggttcaccatcttcccaacattgcagccaaggggttggctgggatgcagtcatttcaaagcttagctgtgggagggtcttctcccaagctcactcctgtgatggttgataagctttactttctcagactgttgactgaagaccaactcccagttccttcccatgggagcctctccacagagcagctcacaacatggtagctggaattccccagagttaagactgagcgggagggagagagggaagaagaaaaagagatggcagtcatgatctttttagccatagctcctcacccagtatttgtcacagtacaggtgctcagtaattaataaagtccatttgcataaaaacgaaggctacattattttatgtttagaagatattagaaagtccgtaatctctctgaaggtatttacttttttactgtttgaatttttgacaaaaaattcagattccctaatccaaaattctcatgctttaaatcccaataagtaaactagtaaatagctttcattaattatttttcaaaatcaaccactcttatactgatgtatttattttttctcaagcatttgaggccaagaacaatggctcgtgcctattttcccaacactttgggaggctaaggtggaaggatcaattgtggccaagagtttcagacagtctgagcaaccaagcaagaccccatctttacaaaaaatttttaaaggcctagcggggtatggtggtgtctgccggtattatagtcccagctacttgggaggctgaggggggaggattgcttgaacccgggagttcgaggccacagcgagctatgatggtgtcactgccctccaacctgggcaaaagagcaagaccctgtctcaaaaaaaaaaaaaaaaaaggcaccaaaatctgctgtgaactttcatatgaattaaggttttttttttaattattatactttaagttctgggatacatgtgcagaacgtgtaggtttgttacataggtataaatgtgccacggtggtttgctgcacccatcaacctatcatgtaggttttaagccctggatgcattaggtatttgtcctaatgctcttactccccttgcccccaccccctcacaggccccagtatgtgatgttcccttccctgtgtccatgtgttctcattgttcaattcctacttatgagtgagaacatgaggtgtttggttttctgttcctgtgttagtttgctgagaatgatgatttccagtttcatccattttccagtttcatctattttatggctgcatagtattccgtgaagcatgtgtgccacattttcttgatcaagtctatcattgatgggcatttggattggttccaagtctttgctgttgtgaatagtgctgcagtaaacatatgtgtgcatgtgtcttcatagtaaaatgatttataatcccttgggtatatacccagtaatgggattgctgggtcaaatggtatttctagttctagatccttgaggaattgccacactgtcttccacagtggtcaaactaatttacactcccactaacagtgtgaaagccttcctatttctccacatcctctccagcatctgttgtttcctgactttttaatgatcaccattgtgactggcatgagatggtatcacattgtggttttgatttgcatttctctaatgacaagtgatgatgagctttttttcatatgtttcttggccacataaaagtctcatatgaattaagttttaaattatctacattatacaagttgctggtgtaattctgaattttgtacattttgataacttatttccaaggagggagcagatttagggataaaaatggttgtccttttagtctcactttataaaatactcattagctcaagtgaggaaaacatattgaagagataataaaatactgttatgtttttaaatgtttttatccctgactttgaattccttatgaaaagaagaattttaaaaactttttctacttagaatcattttatgaaaattcatattttagatatgtaataaagaactaatgcaaacatgtgagttttgttagtagatgttccctcttctaaatgtacaattatcctacatttacatttctcttaattacctttaaaacagatatcagaaaactatgggccacaattcaaatttggcccacatcctgtttttgtttttgtaaataagttttttagactatcttatttcctcataatgatcaccaacatttatcactatatgctaggacaaagatcaattcttctcagattcagtatttttgaagactcctcctcctcctcttcctcctcctcctccttctcttcctcctcttccacttgttttagagacaagatctcactgtcacccaggctagagtacagtggagctcactgtaacctcaaacccacctcagcctcccagagcattgggagtagctaagactacaggcatgacccaacatgtccagctaatttttaaaattttatagaaatgagggctcactctgtgactctggctagtctcaaactcctggtctcaagtcttgcccccaccctggtctccgagagtgctgggattacaggtgtgagctgtcatggcctgccaataagttgttatgaaacacaatcatgctattttgtttctgtattttctatggctactttcatgactcagtggcagagatgagtatttgtgacaaagactgtatgacctgctaaatttaaaatatttactctctggcctttacagaaagattaccaacctctttctgaaaatgttaagcatttttattcatgaacatggtataactctctaattatttaggtcttatttagttattctcaacaacttttacaattttcagtgggctggtcttgcacatattttgttaaatttattctaaatattttatggttttttgccaatatattttctttttaatttttattcccaattggttgttactattatacataaataaaattgacattgatttttgtatattgatgttgtatcccatgactttgctaaactcattttatagttatagcaacttttttgtttactcttttcaattatctatgtagaaaatcatgttatctgtcagtaaatacagttatattcttatcaatctacattcgtgtacttttattttcttcttattatttttctttttttttttttttgagacgaagtctcactctgtcgcccaggctggagtgcagcgccgtgatctcagctcattgcatcctctgcctcccaggttcaagcagttctctgcctcagcctctcaagtagctgggattagcaggagaatcacttgaacccaggaggcggaagttgcagtgagccgaaatcgtgccactgcactccagcctgggtgagagagcaagactacatctcaaaaaaaaaaaaaaaaaaattcaggttgtcgtatgtcccctctagcagttccattttgatgggaaccacctgttgtggggattctacttgatctcctcattcaatgtgaaaggtccccttaggtaccttatcaatttctctcgtctcttcagtggggctagagacaagttgctgagaaatctaaaccagaaacacgggaaaggaaggcacagccacagtctctgccattgtgagctcgagtgagaccaatacacaagttgtcattagggtatggagacagcaagaggaagtgtctcccattctcctgtcctcagatgcaaagtctgaagtttcctgcttgaggcctgtggagacgtctgacttgttcagctcccgtgtaggttcttgggccaggaagctagcaccttctctctagaacacatctttggcccaaacgttgagcttcctccaggaagatcctcaccccagagctttcccctcaagtccccagatactcaggccagagaagaaaaatgccctgggagagtctttcaaggcctgaatcccattctcccagcccacccaactcctccaggccagaagcaggcagcatggcaggttcatccagtcaccatcttcccagaagtcttctaggaccttcataatctgtttcattatttctaaaatcctttttttttttacccagttgtatataaatccttcatatgaatcataccacattcattataatagcatatcatatctgtgccattccctccttgcatggaagcactctgaggagagaggtgttttaattctgtgctgtcttactgcactaatctgatgtatttatttaaataacattaaatgatattaatggtgtattgtgtgtctagaccggaatataaccaccgttaaagagaaacctgcaatattcctattctctttgtagcctcagacatgtgcagtgagcaaagacttcaaatgccatgtccctggagcactccttgtttacattcatattaagtccctgggaacacaaggaatttatttagcaccatgagagttgtctgcttctgtggttgttctactgtgatttctttgaataatttatcagctacttaacactcatcaaatttggctttttatgtagagaaactatctgtaagttctgttagtttttatctcagagtctgagatactgtcattttaaataaatgcttttctctctaaacaagaattttaatactggaggaaagaaagaaaaacctggtgtatcccgtgactgccttatgggatcagtgtgaagcatctctttatgagtctgtgtgtacttgaactcgttgtcttcccatacttactctcgtttgcatcattgctcgtctttctttttctgtctcaggtgctggggttccccagttccagccaattgccctaaatggccgaatccaagttctcagcaatgggtcgttgctgatcaagcatgtcgtggaggaagacagtggctactacctctgcaaggtcagcaacgatgtgggcgcagacgtcagcaagtccatgtacctcacggttaaaagtaagagagaagaaatgcttcgttttacctagtttaaatacataggtctctgggggcttcctttttcaattgtctccatacatacctgtttaaaagcaacacaaaagaagacccgttggtgtgatatagctgggtttaaagttttgttgttctggaaacatgattgaagaggatggtaaacatccagctaattgttgacagtgtgcccagggccccttgtgtgtggagcatgagccacattcttctcttcctttggttctcacagccattggtatgggctctgggcaacctagcagatgagtaggtctctgcctttaacacccacattgctaccctgttgattttcccgtggaaaaactcaatacatggtctcagatgtgctctttacaaagccttttgtcatgcattttgttatttgcaagctgtcttgtccatggatttccttttaaggatcattttaaaatcaagtgactagcgaacaactacaagacagaaatgtgtaagactaggcttaatgctggcgctgctggcccaatatatagaaaaaggtgcgttataatgaaattattctcatacattggtaactggcaaccaaggaaaggatataaagtgaaccagttttactgagttgtgcttattaacaaaatgatggtgcatctagtttacagtgaatggcttatgcccatttatggaattttccatcgaatgaactgtgatttcttcttgattacaaggctttattcagactcccctcccactttttttttgaggcagaggctcactctgttgcccaggctagagtgcagtggtgccatcaaagctcactacaccctcgaactcctgagctcaagggattctcccacctcagctttcttagtagctaagactaccagtgtatgccactgagcccagctttttttttttttaattttttataaagatgagggtctcactttgttacccaggctggtctcaagctccttccctcaagtgatcctcccctcttggcctcccaaagcactgggattacaggcataagccactatgcctggcccttggatttcctcttttttttaactttaattctgctatggatagtttggaaaagtctctactatatgatttattagaagaatgagatttaaaagtggcattcaggggtgtgtgtatttgtgtgtgtatgatattgaaaggctagctaaacagacaagtatccatcctaactcacgaagaatttattttagttagtccactatttccaacagaacaaaaaaaatccaagtgtttatttattaaagttttatattgtgaaatggattataattatgaaatggggttgttttggaatatattttgcacatactcaatacctagtttttgacttttaaatcgtatgctctggaggaaatgatgtgcaagaatttgataacgaattgtggtactgtttaaatccagagctgaaatggtaatttttaaaagttataaaggaaacctaaaatctgaggagcaatgttgaccagagtcggtccatctttccccaaggaaaggggtgtattttgcagttattttaatagactttaaatgcataagacaattttttagtccataaacacatatctaggacccaatatatataagaccctatgaaggatacaagtacaatcaaccatgggccttaccctcatgagtgacaagcctcatgttttggaaggggagataaccaggaagaagatagaagccactgattacaatgcagggtgaagagtcacatggatcatgtctgtgacattcagaggaggatggaaatgtcagcttgggggaattaaggaaagcttcatggaaaataggcttcaagaatggacgatgcccccatatgtcctctctccagatctcggtactcagtggcagttgtgcagcatcagggaggactaaggagatgaggtggcccctgccctctaggagcttttgctctctggggataattgagtggatatatgtccaattcctgtctggcagaatacacaactggtggaacagagcccagaacaccagggttcatggaagagggtatgatttgcttctgtttgtagaatcagtgaccgtgtggaatgaactgaatgtctgtgtcccttcaaagtccatatgttgaaatcttaccgccagtgtgatgatactagaatctgaggcctttgaaaagtgattgggtcacaaagggggagccctcagggatggaattagtgtccttatcgaagggaccccagagagctctcctgttctctgtttccaccatgcgaggatatacaagaaggtggcaacctggaggaggatgctagaacctgcccctgctggcagccccatctcagacttccagccttagaactgtgaggaatacatttccgttgttgataagccaccaatgtatggcactttgttacagcagccccagttgactaagaaactacggaacgaaaagctgcagcatctgagttcggtcttaaagacacaagggccttcaaaaggcaggactgttgaggctagatagggtattccagggacaggagacagagaagccagatacaagaaactgaaagactccaggcaagagtaactctctgttcgaatgttctacagtacatggaggagatgggagaggagaacatttaaagtgaacacacttcaaagagagatgatagagttggccaaattttagattcttaaactaatacaagctagtcatggacaggtggatttaaataagttaaatgcacctcttcatgactgtttgtattagtttatctctctaggcctagaaaataggaagaactatgccatcttcatagagttatcatgaaaattaaacagggtaacacatgtgaaaacacattgtaagacataagatactctaaataagtattccaatacatacatagagtaaatgattctttggttggaaagaaagagaaaatgtatattgatggcacagtgcataggagcatttccagaaagttattctgaaaaaaaattaaaaggccagaggctaggaaaagggaagaagaaagaggacctccatggcccatggggaggtattttcatccttgtctaatactcgtccaaagctcagccctggagtggtgtctttagcaactctaatggccaatgtcttttgcctaaccctagttgtttaagaacaatcagtaaagtgttttaggatctcaaactgaaaaaaaaaatagatataaaggagagtttactggtctaaataaacacattaagtactctcccctttctgtaagtcattttaaaaaatgggctgcaaatatttctaaattcaataggggagaccttgctgtctaattggatgatgtcaggaaattaagacagctgctcctgcagcaagtctggactcccaggatggcctggtgctggctgtaaacataatttaaagacccaaactctccggataggacctgcttctgggggctcactgtgagatcctgcgaaccctgcacagagggtttctcctatatgggaaattttcttactgctttcaagaaacatcactccaaaaataaagcattttaacaataaacacccaccacatacacacacatctttttgttgttgttattgaatcaagcataaggaagccacaggcaaagaagaaagccagcaagcatgtatggaattgtcatggaaagcaatcaatgggatggaaggttactgcatgcaaatctttccagctctgttggggttcctgtctgtgagtctacactgtcatcacaattctggtttatgttttacccaaaataattatcatgtgagataacgattaggaggcttggcagaaaaggcagagggagtaggctctgcttgcaatcaaatttggcctctggtgatgacatcctgccctatgctccaggccgatcgggggctacagaagctatgccacttatgtgccccttcccccaaccaggaactgtttgaggcccagggaatgactttatgttaaaaaaaaaaaaaatagctctgtcaatcgaggaaaataatgagacaagtctcaatcattttaggatatttatttgccaaagttgaggatgctcccaggagacaggtctattcctttctccgaaggtgattttgagggctccaaatttaaaggggaaaggatgagatattgagaagcacacagctttcacataaacaaaaggggcagaggaaaactgtggggaatgtgcattttacataccacagacaaaatggagaggggaacgttcagttatacatttgtgtctggtgggcagagcgactgcacctgtaaagataggctatcaagttgcattgccatggggaagctttaacagctcaccaggaatttccttgtgggcaaaatatgagggaagcgtgtagcttttcatcttgtagccatcttgtttaggaaccaaaaggtggaggcagatttgcgtgacccagttcccagcttgacttttctctttggctaaacgaatttggggtcccaaaatttaatttcctttcacagctccaaaacccactgaatctcttaaatggatagccatccctaaggtttgtctcagatgcccaaattacatcctccccgctcccaactttctgccactggctgatctgaagcctcgtgtttccgggaacactggtttcagcgtgaacctgtggcccacagtgaacaagccgctctgcttttgtgagctgctctgcataggtcctttctgatccctgcatgcaggacaaaagagcaccgcttatcaaacaggaacaggcgcttccctggagagtcagttactcttggaatctagtgaacccccaagctcccaaagttagcccgtgggctctagtccagcctatgtaatgtggtctccctcctccatgctgaatccaggaaggtctgtgggtcgctgtgcccatcagatttctgtactgtcagaatgcaagtgcacacatgtgcatgcaccaactcactcagctctgacctgaccgtctgcagggtcttggctatttctggacagatctccatgttatgatttgacctcaggccactctcaagccctgccattgccagggcagatatgttgggcctgacatataataacccatctccttttctgttgaaaacatgtgtatctatgcctggataatccatagtcaacctcctttactttctgccctcacccactgccaccagtacccacaaatctttatcctaacccctaattagctaaatggaaatctccagtcccggtagcattgctctgtgatacttcttggaggaggaagtagcccagccccaagctgcccccaagcggcccccaagctgccccccatggtgaagctttggccaccttgaattaaccccacatgtttcccaggctctttatgatcactcagtctgctgagccaatcacctcccaccaagcccctcttccaacactggaattaaaattgagcatgagatttgggtaggaacacagatccaaaccatatcaatcatcatttctgaattatagtttaagtccttcccaaacatgacaaattagtgcctgaaatagaatatgaggtgtcccaggtttgtgaacacccagcttatgcactttcctaaattcagtcaccagcacccccagcagtcctcccccaacaatttatcctgcacatatgcaacactcagatccctcctgcttcactctcaagtccagttgccagatacgtctgcaactttgctgggagtttttccaaggaaggagtctcccgcagaagcttcagagggactgcagctgtgccagcactttgattttgcacttctggtccccagaattgtttaagcataaatttctggaggcagaagcagagaatgggaagaatccagggaacgtaagtgtgctggaggggacattgcttagtgaaggaaacccctcagcagctgccacgcccttggtagggcatcctgagctccacccaaacatatgcatttcccttcctaagtcagcctgaagttccaccagctaaagattctctggggtaaaaaaggaatttgtaaaacaggagggtccatatagcagatgcaatttgatccctgctccagtttcaatttccctcctttctctgtgctaaaaattgaattatttcccgtccaccccctagatttgtatgttgaatttgtaacctccagtaccttatatgaccatatttggaaatagcgtacttgcacattgcaggtataattagtgaagatgaggctctactgaagtaggccgccggatccctaatccaatatgactggtgtccttattaaaaggggacaatctgggtgcagacacagatggaaaacatagctgggcaaagacagagattggagttatgctgccacaggccaagagacactgggcaaggcaaggaaggggtctcctgtagaaacttcagagggactccagccctgccagaactttcattttggacttatggcccccagaaagatgtgagaataaattgctgttgtttaagcaccccagtttgtggaactttgttacagcagccccgggacaccatacactcagtgacaacagaactcttttgcggtcttgtgttggagggaagcccaccacaggccagatcccctgcctaagcagaagagtccgaatccatcaaagccactgggtgtgagccctggccgggacccatcaaacgcagcagctccctttgattgaaggatgggcagacaaccagaatttgcacaatgaaacgtaaaaacaattcttttgaggagtttctggagaagatttccgtattcttaatacgggactctgcaaaagaggtttatcccatttaattcttgaccccatgatgtctggcagtacatgagatcacctgggactttattgcctttgctgtctaggccaatgtgggtcagggtttttgcatttgcagctggaggcatccaaactaattagctaaggagagagcagcatctccaattcatggagtgcgattcagccacagtgttcccctcggtaatcctgctgaaataaatggctctgggggaatgaggagttagatctggattgagaagctatagggatttgcagtgcatgctttgggctggggcagaacagctccgtgggaggatagctgaaggtggatggcagcactcggacctgggcacatatggtggcttacagcagggagctcagtacctggtgagggaggttctcctgcctcagcttcccgagtagctgggattattatagatgcccatcactacacctggcttatttttatattttttcagtatagatggggtttcaccatgttggccaagctggtctcaaactcctgacctcagttgatctgcctgccttggcctcccaaagtgctggaattacaggcatgagccaccacagcctttcgaaaaattactggggccagtaaaaatcttatgtttccactccactgttctcctcctcctcctcttcatccttctgttttgaggcacccttctaccaagcaactaaaatgttattattttttttaactttggggtaattgcgcctatttcaatgtttttcagttgatttaaggtccttctgttccatggccttcccctgtggccagtggcactgatgttctgaaccctcaatcagccattaccttccacactggcatctgctgagaagtctgagtgccatatggtccttgactgtggggtcactgcttagttcccttggaatctcctcctgtcttctggctgcccctgaccagacccacccatttgcccatcagcagggttcactgaatgctccctagtgtcaagaattgttctacatcctgcgtgctctgaataagaccaagtattagttcaccgtcatgcagcacaaattcccttgagaaagacatggagatgggtatataacataatgcctggcagaggatacagtgatgtaagaaagcaaggtgtgcatacgtcttggagaaagcattccaggcaaatgaattagcaagggcaaaggctgaagggagaaattggttacatctgtggagcagcagggaccctgtttgctggaatgtatatatgtgtgtgtatttgtatatacttgtgtatatacgcatgcctatgtttgtatatatacacatacagtatacatagacccacacaatccagatttttctttctttttttgaggtggagtttctctcttgtttcccaggctagagtgcaatggcacgatctcagctcactacaacctccacctcctgggttcaagtgattctcctgcctcagcctcccaagtagctggacttacaggcacctgccaccatgcccgtctaagttttatattttagtagagatggggtttcagcatgttggccaggctggtctcaaactcctgacctcaagtgatctgcctgcctcagcctcccaaaatgttgggattacaggtgtaagccaccacacccggcccataatccagattttatgttatatagttatgtgctgcataacaacattttggtcagtgatggaccacatctatgacagtagcccttaagatggagctataatggttaacatacatctaatatatgtgataatggacaacatcctaacattgtaacttaatgcatgactcacttgtttgtggtgatgcttacataacaaacctactgccctgccagtgtacgaaagcagagcacacattatgtacactatgtaatacttgtgataataataaatgactattcatggtttatgtatttactaattgttcataattactttagactactccttctacttataaaaaaaaaaaaagttaactgtaaaacagctcaggcaggtccttcaggaggtgtccagatgacctgttacttgttttttcattttttaattttttctatttcaatagctttaggggtacaagtgactttgatgacatagatgaattgtttagtgataaagtctaggattttaatgcacctatcatctgagtagtgtacattgtactcaatatatagttttctatccctcacctccctcccaccctccccacttctgagtctcccgagtccgttatagcactctgtatgcctttgtgtgcccaaagcttagctcctacttataaatgagaacatgcattatttgctttttcaattcctgaattacttcacttagaataatggcctctagttccatctaagttgctgcaaaagacattatttcattatttttatggcttagtagtacttcacgatgtgtgtgggggtgtgtgtgtgtgtatatatatatatatatatatatgcatgtgaaaatttcaagatgatatatatctaacatatatatatacacacaagatatacaagattaatctatatataacatctttatatatataaaatttcaagattatatatatatatatatatatatatatatatatataaaacatctttgtccattcatcagttaatggacacttaggttgattccatatctttgcaattgtgaattgtgctgtgataaacatagacatgcaggtgtcttttgatatagtgacttcttttcctttggatagatacccagtagtgcgattgctggattaaatggtagatctacttttagttatttgagaaacctccatactgttttctgtagagattgtgctaatttacattcccaccagcagtgtgtaagtgttcctttttcaatacatccatgccaacatctattgtttgttaactttttaataatggccattctggctaggggaaggtcgtatctcattgtggttttaattggcatttccctaatagttagtgatgttgagcagttttttcacacgtttttggccatttgtatatcttcttttgagaaatatccattcaggtcctttgcccactttttaatgggattatctgttttttcttgctgatttctttgagtttgtagattgcggatattagtactttgtcggatgcataattttcaaatatttacttccattctgtaggttgtctgtttactttgatgattatttattttgctgtgcagaagctttttcattaggtcccatgtatttacttttgcttttgttgcgtttgcttttggggtcctagacataattctttgcccaggccaatgtccaaaagagtttttcctagggattcttctagaatttttatggtttcaggttttatatttaagtctttaatccaccttgagttaatttttgtatctggtgagagataggaatccagtttcgctcttatatatgtggctatttgattttcccagcaccgtttattgaataagttgtattctccttaaattgtgtgtctaatccattatgtttttatatgctttgtcaaagatcagtcagttgtaagtatttggctttatttctgagttctccatcatgttccatttgtctatgcatctacttttatatcattacaatggtgttttaattactatagccttgtagtatcatttgaagttgggtaatgtgattctaagaataaatctttttgcttcggatttctttggctattctagctcttttttggttccctatgaattttatgtttttttttttattttgtgaaaaacgatgttggtattttgataggaattgcattgaatctgtagattactgagcagtatggtcatttccacaataccgattctttcaatctatgaacatgggatgtttttccatttgtttgtcatctatgatttctttcagcagtgttttgtagttctcctttagagatcttttcacctccttggtagagtatatttattaagtgttttaaaaataaagtgttttattttctttgtagctattaaaggggttgagttcttttttttttcttttttttttgagacggaattttgctctgtcccccacactggagtgaatgaagtggtacgatttcggctcactgcaacctctgccacctggttcaggcggttctcctgcctcagcttcccgagtagctgggattatagatgcctgtcactacacctggctaatttttatattttttttcagtataaatggggtttcaccatgttggccaagctggtctcaaactcctgacctcagttgatctgcctgccttggcctcccaaagtcaggcgtgagccaccatgcccagcctgagatcgtgtttgattctcagcttggtcattgttggtatatagcagtgctactgatttgtgtatattgatattgtaacctaagactttactgaattcatttatcagatgtatgagtcttttggaggagtctttagggttttctaacagaggtagttttacttccttttttcctatttggaggcccttgatttctttctctttcctgatttctctggctaggactgccagtattatgatgaatggaagtggggaaagtgggcatcgttgtcttgcttcagttgaatgctttcagcttttccccattcaattcagtatgatgtgggctctgggtttgttatatatggcttttcttattttgaggtatgttccttctgtgcctagtgtgttgagagtttttatcataaagggatattagattttatcaaatgttttttctgcctctattgagatgatcatatggtttttgtttttaattatgtttatgtgatgaatcacattttttgacttgcgtatgtggagccatccctgcatctttagaattatcatggtgaattatttttttgatgtgctattggattcgatttgctattggatttggtttgctagtattgtgttgagaatttttgcatctgtattcatcaggaatattggtctgtagttttcctattttgttatgtcctctcctggctttggtatgaggatactggcttcatagaataagttaggcaggattccctccttctctgtcttttggaataatttcagaaggattggtaccaattcttttttgaatgtctggtagaatttaggtgtgaatccaactggccctgggctttgttttgttggcattttttttttattgctgattcaatatcactgcttgttattagtctcatcaggatttctatttattcctgatttaagctatggggttgtatgtttccaggaacttatttatttcctctagattttctagtttgtgtccagagtggtgttcatagtagtctcaaatgatcttttgcatttctgtggtgtcagttgtgatgtctccattttcatttccaattgaacttatctgaatcttctttcttttcttggttaatctagctagtggtctatcaattttatttatcttttcaaataacctccttgttgtttcattgatcttttataatttttttgtttcaatttgatttagttctgctctgatctttgttatttcttttcttctgctagctttgggtttggtttgttcttgtttcattccttgaaatgtgatgttaggttgtcaacttctgatctttcagacttttaatgtaggcatttagtgctgtaaactttcctcttagcaatgcttttgctgtatcccagagattttgataacttgtgtcacagttatcattcattttgaaaaaaaatttaaatttccatcttgatttgatggttaaccccaaaatcattcagaggtagattgcttaattttcatgtatttgtatagttttgagggttccttttggaattgatttctggttttattccactgtggtctgagaagatacttgatatgattgaaattttctttgctctgctcacacgtttattcatccaggtaaacctaaacatgattttgtctatttcaaaaataaccattaagtaattatttatagaataatttaatgtgagggacccacctttttaccatattgagtcattatatccagaaatgaaacttctctttattgtctttagttttctggtagattccttaacgaagaggcacagttgtctccattttggacttagacatattttattaatttttaccaaagaattttgaattttgtatggcattttaaaaaggtatcttggctttctcttttatttgtatagcctaagcacacatccttattaatttaatactattggactcttaattatgtttgaatatttttgcaaaattaacagcctcatggtgagatggccaatggcaagaaagctccaaggtgcatgcacattagtttcaacaggagctgcctgattcttttcattgattcaagaaacatttgctgagttcttaccatgtgccaagcacggtattaggcacagtcagccaagcctctgagctgggattcccaaactgctgtccttgtacctcatttctatcactgccctccagccaaagcccatcagtcacatacttgtagggtaccaagttgagtttattcttgtcatgagctaaagcatacaacatggaaacaatgagatgccttcataagagggtgttgggaaggacgtattataaacttgggcttgtgttaggtgatttgggggaaggttcaagtaagtaggacctaactctggagtgacgctgccagaaagtgggagtaattctatgattgggtattgtcttgatttgttttctgttgctataattattacttgagactgggtactttataaagaaaataggcttatttcttacagttctggaggcggggcaagttcaaggtgaagaggctgcacctgtaagggccttaatgctggtgaggactctctgcagaggctttttgctgcataaagcatgacatggtgaggaagctgacctcatctaaatctaattatctcctaaatatcctgcctctcaaataccgtggttagatttcccaccctcttttgggaggtgggcttaaacaacagaaacttatttctcacagttatcgaggctgaaaagtccaggatcaagattctagcaaggtaagttttattctgaggtctcttttcttggcttgtgggtggctgccatctcactgtgcactcacattacttctttatgtacacatggacagaaagaaagaaagaaagcgagagggagagagagagggagggagggaaagagagagagagagaacactcaagttaactctcaggtgccttttcttaaaaggatattgatctaatcagactagaccttctcatgacttcatctcactctaattacctctcaaaagtaattacctccctgtctccagataccattacattggttagggcttcaacatatgaattttggagaggtactaccattaaatccataacattaaatttctatttgtcagggttctccagagtaacaaagccaataagacatatagagagatagtgctatttattagcatacatatttatatctctttatattggtatatatgtatatacttatataagaatgtgtgtgtgtgtgtgtgtgtgtgtgtgtgtgtgtagagagagagagagaataagtttattataaggaattggcccacatgattatggatgctaagaagtcccaggaaagccaatgtgtaattccaatctgaaagccatcaagctctagacccaaggagagccaatgtttcactcgaagtccaaagacaagaaaagaccaaggtcccagctcagccatcaggcaggcagagtttcttcatactcaatctttttgttcttttcaggtcttaaatggatgggatgaggcccatgcacactagaaaaggcaatctgtttgactcagcctaccaattcggctttaatcttgcccagaaacaccctcacagatacatatagaatcatgtttgaccaaatatgtgggcaagatttctcacccccttagcacagttatataattgtggttaagtttcactgtgagtttcagaggggacaaacattcaaaccatagcagatatttaataaatcttgttcataagatgagagaaatgaagccaggctaatgctgttatgggtaaagaagcagtggtcagtcacgttagacaaaagaacagatgtttggtcattgttgtggtttctttgaacaatgctcatgctattgtctatgttcaaacatgataacggaggggtcttcttttgtcttgatccatctcggtcacagagctgttttgtctgatgttagtgttttgtgaaattgtttatcttcaataacagaacaccaaggcccaggtgggagttcccagccagctcctggatgtcgggggcttttttccaatctctagtttcattattatcatgtaatcatttttaatatcattcatcttgaaaaggatgcagaagacaatacatagttttgtttagacttaattaagaagagaagctacacataagtgctttcatcaagggccactagaccagtcttattgcaaactcagctgaaacaagctcctgacctgcaatgggccttgtgaatgggtacatggaaataagctgatggacaggcaaggcttggagatgtttctctgatgatttattctttgtagaatgcaagtgcctggttgtgatgctcacttttctcttgaggactcccaggtgtgaccctctgcagggaccatcctcactcctcatgttaggacatatccaaagacaacagctacggagcagagtcactgatgcacatttgtaaagcaatggcaggtcatggcaagtgtccatgctacagggcagtgacccaccatctgctctttgcagttcagctgtggctgaggcaggaaggcagagacagggctggaggtggtagacttttgaatatactgttttcccacctatttatttcaatttccacacccttaagccaattgattccagaacctcaagttagatgtccactttttgtggctatccgtttggctactgattgtaagacacattacagaggtgtacagtccatgtatacacaggcaagtaaggatcttctcattccaaagatgcttgagcagaaaagagcacctgattttcagctcattctgaacactggaactgtgactttaatcatcagtatgttgtataataaaacctgaaggactacacaggataagcattgttagttaagaatggctgactcggctgggcgcggtggctcacgcctgtaatcccagcactttgggaggccgaggcgggcggatcacaaggtcaggagattgagaccatcctggctaacacagtgaaatcccgtctctactaaaaatacaaaaaactagtactcttgtaactgtacaagagtacaccgaacaaaggagacagggtcatttataacaggtgtggtggcgggcacctgtagtcccagctactcgggaggctgaggcaggagaatagcgtgaacctgggaggcagagcttacagtgagccgagacttcgccactgcactccagcctgggcgacagagcgagactccatctcaaaaaaaaaaaaaaaaaaaaaaaaaaaaaagaatggctgactcaaaactttcattctctctaagaactattcagtaaccagtattcaactgattccagttgtagccttctttctaaggaaatggaggtaacttttaacttctgggcccagatgcatcgcctctttacaggtgtggcctaattctcatctctggttggtgctgtgggatctgctccatactgggaagtccctgtctagcttcttgccccttattacttagcttctgtatttgctcagagtggagtctttattcttaatgagaaggagggaagccatatgcattccagggagatggtataaccagagaaaaggccctatggcaagaggaagcttggtgtgtttcctccatgacactgctggggtaaaaaaaaaaaaagagttcattaaagaggagatcagatccttcgagggaggtgagaactttgcattgcactctggatggatggccaggctcttcatttttcctttttcctagtaggcatattcatatgtgtaagcgttttctcttttaagaaaatgaaatcacagagtatatgttagtatgcatttgctttttaagttgacaatatatcacagttgtctttccagacgttagaaatacttgttcctcagtgccataaagaaatagcacttcaacataaatttaatctcctcagcagtgccatttttactttctgcagaaggggtacacccgccagcagttttgccccaagagtacaccaaacaaaggagacagggtcgtttataacctgaggtgtccactctactgctgtgtctggtttccattggctggaacgggacctcacattctgtgtttgtctcgattggctagcaacttagaactttttaaaagaggtaaagagagaggagaacaaaagaaggaggaagtaacttgtggaatgctgagaaaggtagaaacaccttcaaataaggaagaggaacaggctatgacctaatgcttgtttggaccagtataagcatgccagggcagatatttaagctaaattgtgggagctaagaacataaagtaccttgatttcttcattgcggctagcagacatttaagaatgttagcacaggtctttgaataaatttcgcttctaagagaagttactgtttattcctatttagatggggaggaaagtctttgaagaggaacctctactttactttttacacagataaatacacatagctccattttattgtatttcaggagtagctcatatttcactttatggtttggcatcattttgcaactgttatcttagttggacattcagcttggaaacaatttcatgtgttcctgtcatttgagaataacatttctaggccttggaagtagtaggttctcaaccagtgtttgcagcaggaagaaatgcaagagggaaagagcaggagagctgatgccagacatagaagaagatctccaggaagaagttttggaagacatgcttttaggttttcatcgcttctcctttttgtatatggtactgctgaatgctgctaggaacaatactttctccccggagatgcaggtcagatgccatgttttctgtggctcatttagattgatacagaatgggccattgctagaaaatggaaacaaaacagtcagaaagcacttcacaattctgagtctgtagccattgattgtaaatgtgcaagaggagaaaagagcacttttgcttaaaaccccattgataatgcagcaaggggaaggtacattgctctgtgaaaagaataaggagaaaggggctttctgtagccataaactgcattaacaggcacataataccatgagtgttgtcattgtcatcacaccatggagccacctctgtgctaccttggccatgtattgaagccaggagaaaaaaacaagggtaagtgcatgagcattaaaaaaattaacgtttggaagtcctgagttgtcttttattttctgcgacctctgagaagcccctctttctcatgtgccactgtaaaattatttccacaactgtaaaaattgggattgtagtaatgctaaatgaatccattctgctcattcagtcctgtctcccaaggtaatcactgtaaaaggctaaggatgatgcattatgagagaatagcatagccatgtggagaggcagtgccagggagtgcgtttgccattgtgtgtgtgtgtgtgtgtgtgtgtgtgttcagcaaatacagccagccctttgaatctgcagcttccacactcatagattcaaccatcctcaaataaaaaatattcagggaaaaaaaaacaaaaaaatacaacaataaacataaatacaaatataacacagtacaatacaacaactatttggatagcacttgtattttattaggtttcatatgtagtctagatggcacctaaagtgtgcaggaggatgtgtgtaggttagctgcaaatactaggccagtgcatatgaaaagtcttgaactctctcagagttttgtatcctgtatgaggggttcctggaaccaattccccaaagataccaagaaacaattgtatctttgttttctttcctctcttatcccattatcatataacatatgatacattgatttgctatcatagtatttaagtattgtcaacttcacatcatagtagtaaagttacgggacattaaggagaggcatgaacatcaccaaaggactttgcttttcttttagggacagggtttgtgtgctttcagttgtgctcagggtagtgatattatgtgaagtggaagtataaccttgttattgtctttatttgaagagtaagtatggtgtaagcagacgtgcatggatgccgagttgacaaggtgtggatttgtgatggttaattgtatgtgtcacttttgctaggcatggtactcagatgcttggtcaaaagccagcctagatgtcgctgtgaaggtatttcttagatgtgattaacatttaaatccatagatttttgagtaaagtagattatccttcataatgcgggtgggcttcatcaattaaaggtccttagaaaaacagactgaagtccctggaagaaagaggagatgctgcctccttcggacccaagctgcacatcagttctttcctgggtacagcctgctggctggcccggcaaattttagacttactagcccacacaatttcatggagtggttccttatcataaatctctctgtctctttgtgtgtgtgtgtctgtctgtgtgtgtctctctctctctctgtctctctctctctctctctgtctgtctctctctctcctattggttctgtttctctgggaagccctgactaatgcagattttgatattagtggcctaaaagttcaggaaggattatattcccacacacatgccttgtagcacccacagcctaaatacctaaatacctccctcagcaaaatgacacatattaacgtgtgcatattttaacatgccgtgaacttccatgctgtttacaaaaagttgaaactgcaaattcactctgtaaatgcttcagggtatgctgcattttaatttgggaatacagagttttaaagactcaagtccaaaacatacattggataccttctgtattagttttctcaagttgccattacaaactaccacaaacttagtgacttaaggaaaatacccttttattatccagagttttgcaggttgggcatccagtggcttggctggtttctctgcttcacatatcacaaagccaaagtcagagcgtccgcagcactgtgctcctcttactggaggacctgggagagaattttcttcctggctctttctgactgtgggcagaattctgctccaggtggctgtgagacagacatcgctgcttccctgccagctgtcagctaggggttgtcctgagctcctataagcctcattctattccttgcatataatcacttacatctcagaattagccaagtgtggggtgagtccttctgacacttcagatctctgactctccttctgttctgtttcttttgcttctgtttctgccacaaggcatggactgactcctctgctttcttattctgcatttaaagtcccatgcgatgtctctggacccacccagagaatttaggatcttctccctattttaagatcagttaattagcaaccttcattccatcagcagaatacctttcactgtgtacagtaacatatttatgttccctagattaggccggggaggtctttgaagcaccattattctgcctactgtattgctatgagcaaggactgtaaatgtcctcgcctttaagtcttttatagactcactggggaaaagagccacatacatgtagtagatcatttgtaacattatctcaaaccataacatggggttgcagagcggaacccggcttcatgaatcacaccacaaaaacggagcgggagctgtctgagtcaccactctctggcacagaacacccagcacacagtaacatacacagcaggtactcaatggttaaagggatgaatggatatagaggaaaactgagtaggagacttaaaaaatggagtcgtctcctcaatgggatttaacatcctttatttacctgtttattccataattatatattggaagtctaatctatacaactgccagtgctgggccttagagatgcaattgtgattagaccagggggcctttacccacacggagcttataatttgacattaatcatatcagcagatgaataatctcacagttaaaacatgcaccaaatataatgaaggcacttactagatggcacgtgagagataagggaaagccactctgaggacgctgatttttgagtggaaagctggataaaggaggattgtcttaggctggcttctggcagggatctgtgtgctggaaacctgctggaaagcgcttgggatcaacgccatagggggagtacaggaagttggagaggcacagaaagaagctgggatgcagatgcaagcagggcccagctgatcctgcaaagagctctgaagctgggtggcccttccaaggtggctggggctgggggcctgggctttatacccacccccgtgaaccagtcaccttgattctgtgtgttaagtcataatgtacctcagttttctggaggtgagacctctgttttcaatggttggaaaagctcatgactataagcatcagatgcattcgtattgccaactgtatcattttgtatgcgtcagaaaatcctttcttgcttagaggaatgggggagcataatgaatcagtttaaatttgctcccatcaccaccttccaccgggttctgagcttttacttatttccttatatcatcatagccagtccaacttaaactgtgatattccaccctccccctgcctggagtgtttggtcttttcattcagggtaacttgcctctattgtaatggggtgatatgatatgaggagatcatgcaaaacaaaggctctgtcatttatcttagctgtgactatttatctaatatttactgaccatcaaagccctcactctgtatggaaaacagccttcaatattgtctgacaccaactgggtatcctacaatttagtttgattcaggcactaattacctggagttcgtatcagatcccatgagttaaagggcaagatccctaacaagactgctcttatgtcagacaccagcagtgagtggggtcccaggcttcccacacttctgcctggatagctgcaaattcaagatagcacaccctccttgggtttgataatctgctagaacctcttacagcattcaggaaaatgccatacttaacaattaccattttaccaaaaaggacatgagtgaacagccagatgcacaggtacatgtggcaagatccggaagggtcctgagcacaggagcttccagccttgtggatctgggttgtgccgccctccgggcgtacccatatattcaccaaccaggaagctgtctgagttgcattgctcagagtttttatctaagttttattacggaggcgtgattgattaaatcattggccacatgactgagatctatttctagcccctcttccttccccagaggtcagggggtgaggctgaatgtccccctcctctcatcacatggttggtctttccagaaggccagcccctccttgataatcatctgagggcccaccataagtcacctcattagcataaactcaggtactgcagaagtagaaagggtctgttgtgagtaactgaagacatttctatcactctgaaaactccaagaggttttgaagctctgtcccggaaccaggaacaaagaccagatatattctgcattgtatcatgtaatcaaatacatgcaatttatttggcagggaatttccaggctccctgctatacagtccctaacagagttaggagaatgataaagaggtaaataacatcctccctcccacgatgctccccaatgccttgcagagacttgtgctacagaattccctcactgtggaccaaccatcctaagcccagatagtttctgtagtgtccatggaaacttaggcatcatcgtcctgtgctcacacttcacctgtcttctccctcctggtttatgtcttcctgctcaggtatgtgtaaggcagataaacatgtcacttcccaattaaatagcaaacagaagaatataaattccatttacccactttacaggcactcccaacctctgtgagtgatacgttctcagccccccgccccttacttgggtctagggggacagacaactcgagccttagcactctctagtaacccaggacaattttctctttctccccacttcccccaattttgttttatacgttgggaagttgtggggactggagtaatgattgagagtagcagaacttaagcctttaatgggaatctggttcccatagtcttgaaaaaagtttaaggatgtgatactttgatcctcaatcttgaatcatagaaacaaagtctagggcaatagtaaaaagtccctatcaaaactcacttgcatgtacctggccacccggctggcccttcttagtattttttttctgattataacaattacacaggttcccatatattttaaaaataaaataatagattgaaaggtagaaaaatctctccttatcccaacactcaaaagatggtgatagaaatatttctctttttcctactcaagatctgaaatttatgagggaaacaaaggaggaaaacaacaaaatctcatttgtcaaagataaaattcatgtgagacaatgctgtttatatctatgggcagatactcctcataacttaagctaagaatccagtaggcttacccagacagtcctaggcatcacaggaccccaataccacctctgtaccctaccaaagattagggccacccatgcatactttatggcataaaggtctgattttattatctatgtctttgtaactaattatcacagattttgcagcttaaaatggcatacacttatgttcttacagtttttgtgggtccaggagtccagacatagcttactgaggtcctggcttcaaccatctgaaacaaacagctttctcaatgtcttcctcaaggctgcaatcaaagtagtagccatggcttaggtctcatctgaaggctcaagtggggatctgcttccaagttcatgtaattgttgtcaggagtcaacttgtggcctcacttactctttggctgttggccaagtaaaggtcacccttggtaccttgccatgaggatgtctgcaacatggctgcttgcttgcaagtgtcgtttgtttgttttgttttgttttaaaaaaaagaaagaaaagaaaacatgcaagtggagaaggcaacagagagagttgaaagatggaagttataatatcatgtgagcttatcaaggaaatgatgtcccactatctttgccatatttaagtgattagaagaaagtcacaggacctacctacactcaagaataggagattccacaagggcatgaatatcaggggacaggatcactgggggctatcttggaatctgcccactacagggtgtttcttaggaactgtcagctcccaacaaaaagtacaggaaagggtagagctgtatatgcctagttcccacttccaaactcattatcaagtgtaagtcattccttctatcccaaattaaaacaagggaagactaggaaataggagaagtgttacctcaacaggtctgatctacgtagaaggaaacatcgggaatggtgagaaaaaccctccctcacaaaaaaaaattaatatagtgataaatctccttgtggcctatttttttttctctctgctaatatgtgctgaagcatttttctgtaactagaaacatctgaatgtactgtttaataacttagcctttattctgatctatatgtgttgatttttttctgtgttactcagtattcttctgctatgtgccttttagtggtctgcactctctatcacatggccagcccagtaactgtgtagccagccctcgatggcccatttgactctggtcccttacagcctccaagctgcatcagcagcatagctccctccaccatatttcattgatgacagaagagaaggcaggcagcatgctgcagcacaagggctgtgggagcccagaagtctgcaaaaaggcctccactcccttttcaggatatcaggtgatagagattgagcaaatgctctgtggtgttatcagtgcccagaactggtctgataagcagggaaagacgccaagaaggacagggtcttggagatgcaggtaacatgtgcacccagcccagccatcacccttttcccattcaaatcttgaacttgccaaggtagccctttattgaagagtgcttaattacttccggccacctccatgaacatgaacatgtcagtaatctttcaagtcttctcattagcagtgaggttgggaacgtcagccccgacccagtgcagcacagcagccctcactgagctgtcgctgccacttcaggaaagtgtcttaatgtgagggctgccttttcacagattagtgacggggatgaaaggaggcaacagtgaagccatctggggattcagacattctgggttaattctttgtgagaaaatgtaaaatggccacattttgcactgtattagcaggccatctatcacaactgtttaagtgtggaattttttaaaaaattatgaaagaaccacagaagatgcatcaagctaaattgaaatttttatctgcagcttaccacatagtgtcatatatacactcttactttatgtcttcctgtcttgatacaaccttaaaggaagtagccttcatctccctttattcatatttctaattgaggcccttgacttttttaaaaaacaccaaaattccttaccatgtagaagtttttcagagatgtcgcagaccacatgaagagtgttggggtccccagatgctgcatgaattaagcttgcgacagaggctgtgaatccccaaaccgtcataggtcattctactggcctgaaccctgcaattgccaaacccaggcaaggatacgacattgtctcatgtttaaattccaaggtcatggagtcaaggtcaatgtgagtagaacctgcaaaaacagtacaaagtgaccatgttctcaaggttaaaagtcaagagaaggacctcagcttcctttgaaatggctccacccaggtctcagatgtgtgtcagcttagggtttccttccacttggaatagtgccaggaggccttgatctcagacaaaataccttgaggcctcttccttattaggggctggggctacacacctaactccttcatccttctttggagcttggaggttgttctcttctcttctggctgcaaggaacccctgcattttccccatgaagccatgattacctcaactctgtgtttcctaaagcttaactcccagcataccaggttgcaaagagagctcacttctgaccctgagacctgccacatcacacactccagagagacagctgccttcatgaacaactttctcaaacctgctgaaatgttgctttcatactcgtgtttgttcacccttcacaattcccatgatttgaatatatttctacgctaatgtatcgttttgttttcatgctgctaataaagacatacccgagactgggaagaaaaaaagtttagttggacttatagttccacgtggctgtggaggcctcagaatcatggtgggaggcaaaaggcacttcttacatggcagcggcaagagaaaatgagaaggatgcaaaagcagaaacctctgataaaaccatcagatctcatgagacttatccactaccatgagaacagtatcggggaaactacccctatgattcagattatctcttacctggtccctcccacaacacatgggaattatgggagtacaattcaagatgagatttgggtgggaacacagagccaaaccatatcagctaatatccaacaatactgcaatttgcataactatctgccctgcttcagatgacaaaactgatgttcattggtatgatttggctgtgcccccatccaaatctctactagaattgtatctcctagaatttccatgtgctgtgggagggacccagtgggagataattgaatcatgggggtcagtctttcctgtgctattcgtgtgatggtgaataagtctcatgagatctgatgggtttatcaggggtttctgcttttacttcatcttcatttttctcttgccgccaccatgtaagaagtggctttcgcctcctgccgtgattctgaggcctcctcagccatgtggaactgtaagtccaatccaacctctttttcttcccagtctcaggtatgtcttcatcagcagtgtggaaacagactaatacagtaaattggtacctgtagagtggggcactgctgaaaagatacctgaaaatatggaagcaactttggaactgggtaaccggcagaggttggaacagtttggagggctcagaagaatacagaaaaatgtgggaaagtttggaacttcctagagacttgaatggctttgcccaaaatgctgatagtgatatggacaataacgtcaggctgaggtggtctcagatggaaatgaggaacttgttgggaactggagcaaaggtgacacttataatattttagcaaagagactggcagcattttgcccctgtcctagagatttgtggaactttgaacttgagaaagatggtttagggtatctggtggaagaaatttctaagcagcaaagcattcaaaagatgacttgggtgctgttaaaggcatttcattttataagggaagcagagcataaaagtttggaaaatttgcagcctgacaatgtgatagaaaagaaaatgccatcttctgaggagaaatttgcataagtaacaaggagccaaatgttaattcccaggataatggggaaaatgtctccagggcatgtcagaggtcttcatagcagccgttcttatcacagacctggaggcataggaggaaaaaatggtttcatgggccaacaccagggtgcccatgctgtgtgcagcctagggagttggtgccctgcatcccagccactccagccatgactaaaaggggcgaagggacagctcaggccatggcttcagagggtgcaagccccaagccttggcagcttccatgtggtgttgagcctgtgggtgcacagaagtcaagaattgaggtttgggaatgtcctcctaggtttcaggagatgtatggaaatgcctggatgcccaggcaaaagttcgctgcaggggcatggtcctcatggagaatctctgctagggcagtgtcaaagggaaatgtggggtcagaggccccacacagagtccctactggggcaccacctagtggaactgtgagaagagggctactgtcctccagaccccagaatggtagatccactgacagtttgcatcatgtgcctacaaaagtcacagacattcaacaccagcccatgaaagcagctggaatgaaggttgtaccctggaaagcctcaggggtggaactgcccaagaccatgggaatgcatctgttgcatcagcatgacctggatgcaagacatggagtcaaaggagatcattttggaactttaagatttgactgccctgctggattgtgggctttcatggggcctgtagcccctttgttttggctaatttctcccatttggaatggctatatttccccaatgcctgtacccccattgtatctaggaagtagctaggctttgattgcacaggctcataggcagaagggacttgccttgtctcagatgagactttggactgtgaactttgggttaatactgaaatgagttaagactttgggggactgttgggaaggcatgattgtttttgaaatgtgaggacatgagattttggaggggccaagggtagaatgatatggtttggctgtgcccccccaccaaatctcaacttgaattgtatctcccagaattcccatgtgttgtgggagggtcttagctggaggtaattaaatcatgggggtcagcgtttcacatgctattctcatgatagtgaatacatctcacaatatctgatgggtttatcagggatttgcgcttttgcttcctcttcatttttctcttgctgccaccatgtaagaagtgcctttccctgcgccccatgatgctgagacctccccagccatatggagctataaatccaattcaacctctttttcttcccagcctcaggtatgtctttatcagcagtgtgaaaatggactaatacattcatcaaggttaaagattgacccaaggccacatataggtgaccagctgtctcagtttccctgggactctctcagtctccacattgaaagtcctgcatcctggggactcctcacacagcaggaaattaaaaagctgagatttaaacttgggccctctccaggctatccactgtgggcttctgcctgatttctagcactgttctttacagtagtatggacttcaccttcattgctgttggatacttcttcaccgtgttagtcatgagtagtgcacatctacccaccccaagatcctgctctcctggggcctctttttttttttctttgatatagagtctctctctgttgcccaggctggagtgcagtggcgagatctcagctcagtgcagcctccacctcccaggttccaacagttctcctgcctcagcctcttgagtagctgagactacaggcatgcaccaccacacctagctaatttttttttttttttttttttttttttttttttttttagtacggactgggtttcatcatgttggccaggctggtcttgaacttttgacctcatttgattcacctgccttggcttcccaaagtgctgggattacaggtgtgagccaccatgccagagcctcttttctgcttctttctggacgtataggaagtgagtatgggattcttgcccatgttcactcaggctctctgaacaggcttcttgaggatgttttttaaaatctcctttggcttttatttgagagtctagattcaggcaacacctcatttgatgccatagaatgagtgttcccatgagctgagcagaggaggtggggtttatagagagaaaaggcctgaggaaagcagatacagagaacaaaaatctgatgggtagtttaaaagtgactgtccttaaagggctaaaacagaagggacttccctatcctgccagcttaggtaagcttggccccttctgatccattgctgtggagctcctagtttttaaggaacaggaacctggatcttatcagcaatctaccatccccgttcctcctcctggctagataagtatgaaagcgtcattgatttgtccagtttcagaataatgaaaagcacaaaagcccatggcagaccagaggtgtaatgtccatggctcagggaggctcacacacaatctcttcctcatttgttaattcctggcataaaggaaaaagagagactatgagctccacccacctaagcgagcctccctgccagcaccaaccctgaaagggtgaaaagcagagattcatgtcatcaaaacacttgcaaaattcccctgacttgctgcttgataggcctcccttcagggagaggtgcaggtggaggcatcttcagaagccatcccagccccgggaacctcatgcgaaatcacccagcaagctatgatggactgggctaccctctcagctttccttttttctcatgtgtcagagaggagctagggtaaatcctgaaaacatgaaacagttcccagacacgaggacttgcccttgttaggataacaggcccctttttgtcctaaagaggtcctcccactcagagggatgagcaaactcagggctgctggctgcctctccagaccaaatgcacagctttgatttaaggacttgcaccttaatcacccatcatgtgtcattaccccaacaggcggcagcagccgtaagacacaagtgccaataaattgtgctgaaagttactggagtgattctttgtttattttctctcacagctattctgtgacacttgggctggcattggaacaacatggttgccacatgtaaggaaggggttcaaggtgactgggggaagcaggagcatccctccctccctccctcgattttcttcctgtagattcccagtgcctcgctcagctctctaggaagtcaagcccttggcagtcggcggaaatgagcactgtctcattagctaattgccagtacagattttcaagtacttctgcatgcaaatcataacagcactgagctttcttgctttttaaaactcctctttcacccatcccaccccctggcttctggaggaaaatgaggtctgttacaaactgcacatcagattacttctggggcttttctggctcacgtttcccaccctcgccgccccaacctgagcagagctcctaactacctacctaccactgctgtgagggaccatgaagcagaaggtgctacttagctttggtccagaacaccttcagcagctttcctcgtgcgccccatcccttcaggattcatctcagacctcttagatctgcatcacagaaaacaaaatgcaaaccaggcacagggacttaagaaaatgattgattaaatggagagtagtctactgctgcacaattgtgactttttttttttttttttttccggagacggagtctcattctgtcacccaggctggagtgcagtggcacaatctgggctcactgaaacctccttctcctgggttcaagcgattctcctgcctcagcctcccaagtagttgggattataggtgtccaccaccatgcccagctaatttttgtatttttagtagagatggggtttctccatgttggccagtctggtctcgaactcctgacctcaagtgatccacccgccttggcctcccaaagtgttgggattacaggcgtgaaccactcttcccggtcacaattgtgaattttaataacagtttggctccaatcagtatgataaaagtcataagatattagttcaccgtgacagaatggtccatttccacatggcagtagaccagtttaaaaatggtctcctccttgtgttgtctaaatggggaaggaacaacccatttgggcatcaaggtgcatttattttccacttgtctttagctgtgctttctggggttgacaggactgaaatgaacatcacagatgggaaatgaccccgtcaccgtcagaggtccctccctctgatgcctgtgtggatcactgccccggtagaccgtctccatgacactgggggaaattaatgtgatgacaagcaatggtggctgctggcaagggtgttccattcctctttctttgcattatccttttctcctccagaaatgctcaccgaattcagcaatcacacctgggcattctctgaagtcatggaatacagtgctgaaacaatgtgtggaggagcaaaaaatctaggattttagaaggctgccatgtcacaggcagggctggctttatgggggagcaaacggtgcagtcacacagggccccacactcagaaaaaaccgatgcttttatttatttactgctgtcatcatcttgcaaatcttagtttttgaatgagaagcttcacatttccattttgcactgattatgtctcctgtacaggtaatatgtgtgaaaatattcttgttaaaagtgctcatttctttccttttttcactacctttcactattgaaaaagaaaaagaaatgcatttaagaagacagtctgtgcttttttaccaaagcaaaacaatccaatcaaggaaatgctcaatccatcccctcccacaaagactgaaattttatttttaaaaaaatcactttattatttttttcctttttctttatgattgtacatctgctttaattctaaattgcaaaatgtaacaggagtattgcagggagacctcttctcctgagctttcatgttccaaagtcagtctaaatacatgagaacattcactgtaacagaatcccaggggtggtcccaaagcacagaccagatcactcagctgtgaggtgggagactcagatatcattagctgtaaatagaaaacaggaagcaaagccccagacacaggggagtcttatgttactagaataaaatgggtaataaggggtcaccttcaaggacagaagttgttgagagaaggacctggtcgtggctggaagagctgtacgtgaggtggaaatgagtggtgggaaacagatccagaaaagtcctgtgccagtgaggatagagggttctgctcagtacgcagcaacctgcttcttagctgcttaaacaaagagttgtttatcactcacacaatatgcccactgtggggttgggggcagggggatctgcttattgtgggctcaggatcccagactgacaaaacaagcaccatttcaaagttgcatgtcacagtgtcaataagagtggcctggatggtgccatcataacaaggcttccagcctggaagccacacatggcacttctgctcacaactcattcactgaaggctacacatggtgcttatgctcacagcttatttgctggaagctcatgtagtacttctgctcacagctcattggctggaagacacacatggtaccacatggtacttctgctcacatttcctgggtcagaagacacatatggcacttctgctgacagctcattggttggaagatacacatggcacttctactcacagctcattggctaaagccagtcatatggccccatccaaccacaagggaccaggcagaacaagtttcccaggtgctcagaaggtagatgagcggaaacatgtgacagacagcactcacgatcaccacagagcctaaaacattactttatttacttgattattttgaccgttcatccatttgttcattcattccttcaggagtccatctaacaaagtcattttctttcttttaaaaaaaaaaaaaaaacttttaggttcaggggtacacatgcaggtttcttccataggtaaacacatatcactggggtttgttgtacagattattttatcacccaggtattaagctcagtacccaatggttgtcttttctgctcctttccctcctcccaccctccccactcaagtagaacccagtgtctgttgtttccttctttgtgtttataagttctcatcatttagctcccacttataagtgataacatgtggcatgtggttttctgttcttgcattagtttgctaaagataatggccttcaactccatcgatgtccctacaaaagacgtgatctcattcttttttatggccgcatggtattccatggtgtatatatacggcagtttctttattcaatctgtcattgatgggcatttaggtggattccacatcttttctattcttaatagtgcttcagtgaacatttgcttgcatgtgtctttatggtagaatgatttatattcctctggatacatacccagtaatgggattgctgggttgaatggtagttctgctttttagctttttgaggaatcaccataccatattgctttccacaatgattgaactaatttacactcccaccaacagtgtatgaatgttcagttttctctgcaaccttaccggcacctgttattttttttagactttttaataatagctattctgactggtatgagatggtatatcattgtcgtcttgatttgcatttctctagtgattggtgatattgagcttttttcatatatttgttggctacatgtttgtcttcttttgaaaagcatctgttcatatcctttgcccaatttttaatggggttgtttgtttttcccttgtaaatttgtttacattcctatagatactaaatattagacctttgtcagttgcatagttttcaaatattttctcacattctgtaggttgtctctttactctgttgatagtttcttttgctgtgctgaagctcttcagtttaattagatcctacttgtcaatttttgcttttgttgtgattgcttttagagtctttgtcatgaaatatttgcctgttcctaggtccaggatggtattgcctaggttgtcttccagggcttttacagttttgggttttacatttaaatctttaatccatctggagttgatttttgcgtgtggtgtaaggaaggggtccagtttcaatcttctgcgtacggttagccagttctcccagcaccattaccattagtcattttctgtgggtaagatgtgatagatcttgatagaatcatcaggatctctgcacccaagaagcttagatatggtggggaagctacaaatacctgttacaaggggatcagtggcactcgtcacaaatggcatgcatgcctgtcaggcaatttgttattggaatgtagaggaggaatccaatattttcacacagggcaatcaatggatactgcacaaaggagggggcattggagctatgtagtaaaaactatgcagtttcagtaagcagaggaaaggacgggaatggggaagaaatttctgacattgggaacagcctgaacaaaaacgtgaaggctggaaaatataaggtaatttaggtagaaaaggctcacatgtaattcactgtcatcttgtggaagacacagaatgctattaaaggcagacaaagtgtaatccaagatgtatttgcagaaaagtaatgaatatctatctatctgtatgcaagatacattagaatgggtagagttagaatagaaaaggaggcaaaaaaaaaaaaaaaaaaaaaaaaccagtgaggaagctactgcagtagctagataagaggggatgaaggcctactgaacaaaggtagaatgggaatagaaaggaaaggtggaggtccctgtgggacaggcaggtagatgtggccagccttcacctgcctggcttgaatgttaatcgggagggcttcctcctgtggttgtatagatcggtgctgcccaaagtggggtctggggacccaccgcatctgcattgcagggggcccaggggcagatcttgtgagaaatgcaaattcccctgggttgtaccctggcaatttgtgttccaacaagatctctgggtgttttgtgtgcacatgaaggtctgagcagctatggtagaggcgatgtgcagtgaatctagcctccctatccagtgttcctgccaggacctgatggaagtataactgagatgctcgcctggagaggcccctgcgtatgtaccccctggaatgggcaggtgttagacaagcatggaatacattaaaaagtaaccatcctaaagcattcagggttactgtataaaatatttccagcccggttttctaagtcttttgcatacaacttttgagtgctttgggaactctttctgaggctggattaagtttctactgctgtaacctatgccacttctgagggaagaagccatattgagcctcatctgtccttctaaatcaagtgactttggaagtttcctataaaattctaggcacttatgttcaattactttatcatatcttcccagcatagaaaaacttcctaacccagatgatctcattcaccttatgctggaaaaagcattacattttatttcctctcttataaaattactttctttatctcttgaaaacttagaaggagcctcttctttcatcgttgctttttttgatttcttcttgcacagtaaagtgattaactcaaatttaagaaggcaggtatccaaaaatagcatatacaaaacaggcctacttctctatcttgtgatctaaagcaatgttgttataggttattatttccttttcctaagaaacttgtgatatcaaaattatatttccagcatgtactatcattatttcttctcactttgaaaaaaaaggaaaaactaattttcctgttctttgctagggcccgattcatctttaagtatccgggtatttaaggttttgacatcctgaaacgctgtgcattcttctctgcagaaaagacctttggagcagactttctagagatagggagaaatgatggtaatccatcataatggcctgattccactctggacacataactgttctccatctctgaagccattcctagggaaagtttaaaagatcataagttagacggtgaatgatacacatgatgctcaaattagaatctactttttttcagagtggcattgacgctgcctctcaagcaaagagaagcaggatcatcaccttatatggggacttatatcactgtcagattcagatgagaagggcacagtcattctcacctgaaagtggtaggattctagaaaattacggaaagtcttttaattcctcccgagtactgcactgtcacctctgggagctgtcaccaaaaagaatagttgcatgtcatttaaggccatgtcaagccggtacttagacatggtttaggcatggaaaaggaaagagatgcttctggatggtgttgcttatttaggcaacacacaaattagtcattttcttttcccccagctgctatggcacatgtgagagaagacgcaatgctttccactcagagcgcttggttgtctctgtcttcctccttctgagaggacacctaggccaacatacctgctaggtggagtttagcggtgaacacctctatcccctctcctactcgctgttaggcccagatgtccccaaaagctatccagctctaccacctccctggttttaaaacacagagcctttggctgtggattattgtgtaaagaggagattctcatgagccaaagtctggcccattttcagttcctccacctggagtgccacatcctgagtatgcttgtccaaatatgtccaagggtcgttttcactggagatgagagagctaactaagaatgcagattcccattccactttccagaccacagaatcagacttgggggctggagtcttatatttctattcctggaggcacccagttgattctttggagtattatggtttaaaaaatcctcagattctaccccagggagggccatctttccttcatttcctcccacatatccccatatctgattcaatttttctcccaatcttccacaagctctttggtagacagaaaactatacaccccctccccaggatgtctgtagcccaacccacggaatctgtgaatgtattactttacatgacaaaatgcctttgcagatgtgattaagggaaagatcttgagatggagagatgaccctggattagccaggcaggcccagtgtcatcaccaggatcttcataacagagaggcaagaggccatgaaccaaggaatttaggcagcccttaagagacttggaagacagtgtggctattcctcaaggatctagaaccagaaataccatttgacccagcaatcccattactaggtacatacccaaaggattataagttattctactataaagacacatgcacatgtatgtttattgcagcactgttcacaatagcaaagacttggaaccaacccaaatgcccatcagtaatagacttgataaagaaaatgtggcacatatacaccatggaatactatgcagccataaaaaaggatgagtttatatcctttgcagggacatggatgaagctggaaaccatcattctcagcaaactaacacaagaacagaaaaccaaacaccacgtgttctcactcatcagtgggagctgaacaatgagaacacatggacacagggaggggaacatcacacaccagggcctgtcagagggtgggggcctaggggagggatagcattaggagatatacctaatgtagatgacaggttgatgggtgcagcaaaccaccatggcatgtatatacctatgtaacaaacctgcatgttctccacatgtaccccagaacttaaagtataataataataataaacttctttagtgcctccagaaggaatacagccctgctgacacccttgagttcagacttctcatctccaaaactgtaagagaataaatgtgcattatttcaagagtgagaacttattccagcagccacaggaaatgtctacaacctcctagctttgttgcagtgtttgttcagcaaacctggactgaacagtctccacagaattgttgaagagctagcgctgggatgtgtgatgggcactagacacctacctttcaggagttgacgggagagttggaagacagttgttcagtcattgtcagaagtaataaagctgtccatggcttctcgcactgttctcctcatgtgccttgcctggtgacattggcagcctcctctcagacactagtaagatgaaacatctttgtttcggttatctgagtgtaattaggtagacactgactgcttactgtagatcagtcatggtcccaagctgtttatccatattaactcatttaataattattcctccacaatgatttcagtactattattaacctcattttaaagatgagggaactaatgcctagggctcagttgaccccaggcttctatgaagcagagccaggttgtgagtctgggcagcctgacccctggtgtcactcaaaacccgtcatgtgctctgtgtctgagggctgggtgtttctttcctttgactacagcacctgagatctagctccttaccccatgtatttgtaccctggaagtaacaccctacagaactggaagttctgtacagattttggaaggataaactagcccacatccacggagacccaccagatagagaagagccagaagccctgggctatggtgaccttacaacacggtgagcgtgagccagagctccgatgctcttcagagtgggcactttgagaagcatattttgacttattcattaatcaaatgttgattaagtttcctctttgggccacaccctgggctcagtgcttggcatatcatacaaagcaaggcaacctgctacctatacacagaaagcagtttctagaatgcaggcaagaaacatgggcagctaagttcaaggtttagaattcttctttaatacatgcagctgcatcggcagaaacaagtttatatatttaagtgtgcagatggaagcaagtgtacagaggaaatttatttccaacccacagtgtttccaccctcgatatggtacttgataatacagccacattgtacttcatcacctggggctttggcaacttttgttttagcaaaacaaccttacttttgaataatagaaaaattatccatgcaacagtgagctttttttcttagtcccgttgatgatacaaacatacgtttattgcatctaatgtgacggagctctctcagtaatgatgatggctgttggtgcagtgtaaagggacctgatttttttttttttctgaaaaggaatgcaagcctggtgatgcatcatcattaacttcctagctgcaatgtccttgggagtgaggccaaatttgcttgcagatgaatacagttgaagaagtgtcgaatcaggtgatcctaaggggtggagaagatacattttgaatggaaggcagtgtttggccctcatgggtgtggtgccattttctttcttccgaatggtccttgagaactaaattctgttttccattatttcagctgagctctcttgctgaagggggacagggtgattaaagagctcagaaagagccctacacagaccgaagtagcagctctcttagtcttaattatcggcctttatgtaacattcttcaaattaaacatacagcgaaagaaaataaatgcctccatattttgaaaacctgacagcttcctctcttgtgttttcctacttcataaggcaaaatgtgtttcttgtagaggctagtacagatggttactctggaccatacggttaactgatatgaaaccactgtctgttttgagtctcatctttgtattttatggtcaccatctggccccctgaccatatcccaatgcctcagtagggctgaaggtggataactccattgtaatgtatcactattttcatagaataatataaacatttgctctgctaatttttgtttcttgcatgtagtgtagtagattctttaattacacaggcaaataaattactcctaatactattgcatttctgaagaggctagtttcatacaaacgaggaagagctgatagtgatagtgatttttattaacaaggtctgctatcattgcagacatagggcaactaagtcataatgccctgatatgcttacgaagatctggagctagacggagaccaagaagcctcctgtgacctgcctctaccctgggcttcggggatacatattttactcacattatatttttaggaaaaacaacccaggggaatcattcagggtacatgaagttctatcagcaaaaaaagaaaaaaagaaacatatccacccaaagaattggcaactggatgcatttaaatgtaccaggaaggaatgacagagaccatgtgactgcagaaaagtgagagaagagagaactggatcaagaacatcatagaataggcaaagacagagaggagaagcaggaaacagaatgctgaggctacaatagacaggagttagaatggtcacagaattttcatattccttatttcccaaaagttcaagaaccagccacatcttgactcaacattaccaagtatggaaaagcacgtaatagcttacaatgatcttttcttacaagtgccaggcccagtgggaactgctttgcttatgtaatctcatttatccttgcatcagcctctgaagtggacatgaccatgatttccattttacaggcaaagcaactgtgtggctcagagatgttaaactacttgtccaaagttgcagaactgttctgtaccagagacgagttgacttctgcgctatgtagatcttcacaacttggatggtcttagtagaattactcaaatttaccttgacccaggcaccatgttgtccaaaaagtaattccatgcctcaagagtaaagtgaaaaccaaatcactgttttaagaccgatataatattctgagaatgcagccatgttccgtgctagccagctcttcaggttcactctgtgacaagagctgttgtacattcccagcatgggccttctggttaagaaggactgcaggcatcattagcctgggaactgagatttgcacagactggctgaatgaactgagtcattcaacagccaaagcgaggcaggaaggagtgtgcagaccttacctgaggctgtcagatgttgatacagcctggagccatcttaacatgcaagaactattactgagccatgaaaaagaagtgaattggagtgataccaggtcatgtggaattgctatgagttattgctgcttgggaaagtaaatgccgagttgtgtgtagtagataccgttctgtcaaatgaactataaccaaaaaattgcgtatgtgtgtacatgcgtgtgtatgattgcagagaaaaatatgaaagggcatacaccaggttattaataaagactagagggcagggatgagcatgagggagtgtgtccatgtggaggagaaggacagaaaggtggacataggggcaaaaagtctctaattatatcaacagcatacgtaatgtgtttccacttgtgcaatattacgtgttgtgtgtgtgtgtatcatacataagaacatattgaagcatggtcagtagaaatttgaccaaaattgcctcagactggttggttgaatttttagtgacctttattttcttcatcagatttaagtatatttgtttaggtgagttttttggagcctgcagatgcttttgagtgaagaaaaaaatatatttaaaatattacttggactttaatatggtcatttattaaagttataaatgtaaaaaccctctttttcagttcaacttataaattttgttattctatgtatgtatctcgtaaatttaaacaagtactcttaagggattttaaaaaaaacttttaggttcgggagtacatgtgcaggtttgttatacaggtaaactgtcgtcacgggggtttggtgtacagattacttcatcacccagataataagcataatacccaataggtgttttttctgatcctctccgttatctcacgtgaagagatttttgattaatgtttagacccatttataaacatagttcattttcttctttatatattaaactacatttataaattatacatatttaatttcctttttaaatactccaattatctaacagaactgttctgggcatcttaataacttataaataaataaacaacatgaataacttagtattattatgactccttaaatatcaccctactaggtttaatctcagtaaaagtcctgcttagtatcacctgtctaaattgattacttaattatatatttaaattagaattacaaatatgataaatactaatatgctatatctcataaaaattacagctaaactgcacagatttcttaccataaaaatagtaatgcttggggcttcttctctaaaacatctctgtatggaattctaactctttctggaggtagaagacacttatctactgagaaaacatgaaatgtcaaacagcttgggcagtagctttccgggcacctttagggatattttcctagtggactgaggtttcttaataaccagagaagtcccttgtagagacactgactagcatcttgtttgtaaaattcaatccctgtctgttctaaggtgtatcaaagggctgtatcaaagcttttcctatgggtctatcataccccatgctccgtagattcatacatttattatctgtctcttatggcaactcacaaaagccagccatcccataacaggtggctaagcctcttgatttaactcaacaagtccatttttggcttcttcatatttgaatttttctcttgtttctcctgtcttcagggctgcaactagaaatagaattcaatcttagtgcataatgagtgacgtcatctgcctgtagttacagttctaggtctgccaatgcagaagtagtggaattccattctgtaaacatgcactgtttataaaatccaaaaaaaattactatattcattgtggggtaaacaatgatatttttcaagtagatatatgggaacatttagatgattcctagaatgtaagataaatattaatcacctaaaatgccaagggtggtgtccagaccagtttctcattgtgctgctcaaatatatatcagattggtaaataaaatatttgatcacaaaagaggaggcattaacttttaatttcagctctgacacatgaagagcttgtaggccatcattctcatctttacaacaagaaaaagctggaggccaggctgggtggctcactcctgtaatcccagcactttgggaggccaagacaggaggatcacttgagcccaggagttccagaccagcctgggaaacatgacaagaccttgtctctacaaaaaatagaacagtcagctgggcatggtcgtgtgctcctgtaaccccagctacttgggaggctgacgtgggaggatcacttgagtgcaggaggtagaggctacagtgagccgtgatcatgccactgtattccagcctgagcaacaaagcaagacactgtctaaaaaaaaaagaaataaaagaaaagcctggaaaaactgaaaatcaacaagttttcttacagagaactgaattgacagagataaactctcacccggaaatctagggagataggtgtcacagcgagatacaacaacagagattggcttacctggaacagaagctgctgggccagtgaagtagcaagaacaagcaaatggcaattttggtacagtgttggtggctgagtgtggactggagtgagagtgaggagctcctaaaggccaccgtcttggggtcgtcctcacactttcacagactttctctctaggaaccttaccagattctcacagtgaagatcaaaccttctccataacaaaggtctactctccacggaaaatttaaaaaaaaaaaaaaaaaacctcttccagaaccacattctgaaattttgtctcacctgcaagaaataaattccttcccactccagccctctccagcctacctatatgatctaagttgtgaaaaaaaaaaaaaagcataatcgagagtcaaggcttcagagaaatggattgggcatgctgcagccagagaacagagcagggatgccgggtgggggttgtggggacatctgtgtacctggaagagaggcagacacttggaaggacacggccctgaaacacaggcccaaaaaacactgagatttaatcataagtatggaacactccccaaccctcacaacttatgaccacaaaaaaatcaaactgccagccaatagcagaaagatagctgtaaaatcctctaatatctgggaattaacacaacacactcttcagttatcccatgagtcagagcagaagtctcaagaaaaattgaacaatatttttaactaagtaaaaataaaaatacttattaaaatgtgtggtttgcagcaaaagcagtgtttagagtaaaatgtatagcaataaatccatatattcaaaaagaagaaagatctcagatcaaaaacctaagtctacacctgagaaaactagagaaagaaataaaagaggggccactatgactggtcccatcgactttaaaaggtcagtgctcacagatttgattattcagataaaattggccaattccagaagttaagcaaagagaaactgataaactgaatagtccgatttctattaaaataattgaataaataattttaaacctttcaaaaacaaaaacagagcacaatgttcagattgcttcactggtaattctaacaaacatttaaagaagaactaataccaatgctccacagtcttacagaaaacaaaagcagatagaacacttcttcacccattccattagtctagcattattctaatatgagaaataaaaacattgcaagaaaagaaaactttgtaccattatttcttatgaacatatgatgacaagtatagaaaaagatgctcgctattatttatcattaggaatatgcaagttaaaatgaccttgaaatagtactgtgcatctattagaatagttaaaatccaaagatctgatagtatcaattgctgacaaggatattaagtaatagcaactctcattcattgctggtgggcatgcagaagtatagagccagctcgacagtttcttacaaaactaaatacagtgttgtcttaggatccagcaattgtacacctgggtgtttgcccaactgatgtaaaaatgtatgtccacataaaaatctgcatatcaatgtttataacagctttgttcgtaattgccaaaaatttggaaccaatcaagctgtgcttcaactgatgaataaatacaaacttttgtttggtacatctctcgacagtagaatattattcagctataaagtagaatgatgagtcaaaccactaaaattaagtgcatattaagggaaagaagccagtctaagaaggctggatactctatgactccatttttatgacattctgaaaaaggcaaaacaatagagttcagaagcagatcagtggttgttagggatttggggaaaggagaggactgaacaggtgaagcatgcaggacatttttagggagttgaggatattatgtatgataatgcaaccatgaatatgtaacaccatgtatttgtcaaaaccacagagccttccagcaaaaagaatgaatcttaatgtaggtgaattaaaatgtaattaaaattttcaaaaaaagcatttaagaggtcatgggaccccaggatgaaatggagactgtgcaaatcaatctaattgtattacaaatgagttaaataactttactaattggatgctgacctaagtaactttggagatgaatggaagctgtatgactaaaggcaaaaagaactatacctaaacattgcactctggttgacaaagttgtttctaacagggacttacttctgaaactactatacatctaaactgtaattaaacaattagggccctgggtggcagatcatgggagttgggtttctcaccatgaagtgggagtttacaaacaagctagggaagaggctagaatgagctgtgtggtacctgattagacttagagacatcagtacgaactcatgtttagctgaatagagatacaatggatacatacaggaatattcatagatgtgtgtatatacatgtgttagtatacacacatttttttttctgtcagctaagagaacctggaagcaaggaacaatgccacagtagcaataaacacaactgtccccaaatcttggtttctaataggattttccaataaaatgaaccaggactcctttgagaacgctaattctaagactggtaagggaatataaaagaacttggaacttccaagcacttggaacttcttgtagagttagaaaataaagaagtaccaagaaaaaaaaaaaaaagaaaagaggtggagggggaaagaaaggataaaataaacaagcaatgatggtgatacatcaataggatgtgggagccacctgaaggagttcccagtggttaaatctggaatcatttgagcaacagaacaaataaggcggtattggattataacccaaagtttaaaataaatacaccctgataagtgtatcagtgtaaaataagtgataagtgtaaaataagcccacactgatataaatgattgaataaatggtaacaatagccaaattttcctgacgaaagaattccaagtaatttatgtagatataccacctcaagaagatgaagcataactctcactccttatgtgtgggctttgcagagcgacttccttccagaaaggacgacatggaaagagaagctttccagtggagaaacctggcaggcaccaccttagccaggtggccaaggtcaacagcgacactgataagccctgttgatagcatttacccttgatatgatgtgatgagaatggtactttacctccgtagtttgccccttcaaaactctcataacctcagcctaaaaatgagaaaaacaacagacaagccccaactgagaggtattctacataattcctgaccagcattcctcaagactgacagtcatcaagaacacagaaagtctgagaaactgctacagaggagcttaagaagacatgatggcagaatgtagaatgggatcctggatgggatcttgaaacaaaccagggacattaggtagcaggtagggtcatctgaacaatgtatgcacttagttaacaatgcattaatagtcattcaataattgtaacaaacgtgccacactaatgtaaggtgtaaataatggaggaactggatgtggagatgtgaagtatatggggacttcctgtgttattatctcaacttttctataaatctaaatgtattctaaaatgttgcttattactttgaaaaaccaaatagaagagcaggtatcctcccaggtgtaccagtaagggtagcagtgggggaaaggggtggtactctgtagctacagacctcaaaatacctgtatgatcttaagacagagtcatcacatttcaaattctgagaaatatcatgggaagaacttgagacagctgctaggcctttagaaaacaatttaccccaaatgttgtctactattggtaaagtagcatttcctatcagcctcagtcttgtgacaggccacaaaaatgacccttttccaaagagttggttaacatgccataagatgcctgccctgttctatcttcaggaaggtggcagctgggaggctgagtcattgtgctgtgattctcacaggatgcacctgtcttctggaaaagctcgaagccttccaaatgctttagtgctgaattctcaggaatgtggcttcagaatgggccagagtcaaccatgacacattttatcccagcatcagtctttgatccttaaatgatttttttttcctcctagagcctaagaaactactaaagaaaatgtggtacatatatcatgaaatactatgcagctataaagcagaatgagatcatgtcctttgcagggacatggatggagctggagaccattatccttagcaaactaacggagggacagaaaacaaatactacatgttctcacttacaagtgggaactatatgaggagaacgcatggacacagagagagtaacaagacacactggagccttttggagggtggatggtgggaggagggagagaatcaggaaaagtaactaacgggtactaggcttaatacctggataatgaaataatttgtacaacaaacccccgtgacacaagtttacctgcataataaatgtgcacttgtacccctgaacttaaaataaaaattttaaaaaatgttaaataattgctgaagtataaacaacataaatggcaaattaacttttggattggttaaagatctatattgctgttcttgaaagaggtctctaaacattagagaatgactttgggttcatttgttacagcctgacacaatgaggtctttgtggagggctgcatgggtttgggacattttgttgccaccaggcctcctcacttagctcttgtccgtatctatatttctttcatttcgtagccaaatagaaaatatcattttaatatagaatctcttctgctgcttgatatctctcccgacattaaaatagcacccctaaagaaatgcaaggaagtgaactgagctattatcaactcagtgttcaagggagaaatttctgtttcaatccaagaaaatccgagaacccactgaattacaaagaattgtctaccaagtaataaataaaactatgtgttccacatttgtgtccgcacattgtcaccaaactttctgtgcatcttatctatgttccttattgcagagttcactaccatttggggagaaagtcaagagcacaggttctgagggccagactgtctggctttgtatcccagctctgcgatgtactaactccatctcttccagccttagtttctccaattgtacaacagggatcataagagaacacatctcattggatagataagtggacgtgcaagagttaatgcatgtaaagcagttcgtaaataagtgctatttatatgtagaaagtctttatcaaacccataagggaatagatattttcatgttggaatcattgcctttcagtgtgaaaatatatcaatgtagtgatggttctgggatcttggtcaatggtggagcatcaccaacacacttgtgtctgattccaagaaggtgttggaggacagggggactttctctgccctctactttcttctccccttagttcacacaaatcgaggctctgaggcctggggaaaagtattgttacctttgtgttctctccatggtcccaacaaagatcgtgtggaccccagcggtaataggtagggatagggaagcaactggcctccgggaatatagagacgtttatcaacaaggtctgcactatctcaggatggatggcggggcctcttaatccctcaacctcctggatgagggatccaggagggcactgttgagtccacacacaaagaagggtggaggagaagatgtcatggcttctttcatatctggcaggattttagccgttttgaagatagagaaggcttaaaggttgaaggtgggaaaattacaaattgtagagtatttgagtgggaatgaatgtgggtaaggggttttgagaggctgtgcctgagatcgctgggggaagaggctgggatggcaatgagcttctaaacacaaggcagatgtcatgggcttggtccaaagggcaaggtgcagccgtgaaatgatggtcaaggtcaagtggttggggcaggtcttgtaaacagaaatgaaggcaggcagtaaagagaagggaaatacaagtacgcatatgtgtacactcatctatcattcacaggcttaccttgttggcaggaggatctgagtctgagaatgggcagtgtctttcatgcagttggcctggccaatctcctgtgaacagggatgtttcagtgtttaccagtacacaacctgagtgtatggtgtgtgtacctcgtgtgagtgtcatgtgcttcaccttgtagcatgcacagtacctccttgaaaaggtagtttctaattcaaaccaacttacatttttatcaagagtccatagagccaactacatgtgggattgaatgttcaggtgaccgacaattcaatttaggacaaaacatggacttgttatcttttttgaagtgtcctttttaacttgaatattcactggcatataaatatgaaacgtaagatgtagccttagagatggttgtcccaatagctgtcatttgagaggatgcagtgtctctgatactcattttagaaaatatgaaagcaaatttttatgtttatttttgactattgtaaaatcttcaaatgcagatttaagatgtcatttattgccaattgttgatttttgctcatttgtgcatcaatattagtttatggaattgaattctctttttgcaacgttattgataattttagtgtatatagtagaaggctgcatttcccaagcagtctttccccatcatagagctcttcccatcagtgtcattgcctctagccagacttcttatgtttctgatgaaatgtgaaagataagcatattcctgcaaggaaaccgtaattgttttcaaagaggagcaaacatctttctttcatttcttctcaacattcacttaaacaattgactaagaacaaaactaccagagatgtgtaaataccagagacatttaaatattaaatatgatatccatttatcaccagatttattctcatttgcaatttaaccagatcttgtttgaaatagtgttggtgttcaatgatgcatgagtgataatcaaccagttaatgaaagattatactgctttgatttcttgggggagaaaaatagactgaatcataggatatttaaagagttcaaaaattctttttcagttaaaaaatccccatttttatacctagccgaaggttttctcaattccctagtacatacattgttatgacactgtgggttattttgagaaattcattttgcttcatcctgatttcattcattcttcacttctctgaaatctaggaaatgcaagtgcattccccagggacccacagcatgtggggtggggtaggggtttccagaagctctccatccttcctgatggaggcaaccatcacatgggcctatctgggcaggtgggaaatatgagagggcatttttgagcaccctctctgttttagagaggccattaaatgtgttcacataagtgttgtcattctcatactcagaaaccattctaaccttcataagtgaatgagagcaactttttattaatgttgtaacttttaacaatttcacattgaaatatagcctaggcattttattagatcatgttaacaaccgctattgatgacttaaaagacaaaaaaatctatttagatagatacatggatgtgtctgagcatgtgtgtttctaattataatgtgtatatatgatatgactgtagaaaaaaaaggtaacttagattttcgttaaagatgtttaaaaatactcttctggttctgagaaaagctgtcttcctattggagctttttttacctgtgtttaggaagcccatatgtcatgctgcaagaaaagaatgtgtttaagagctgaaaatggcatttcccttaggatagtagcagctggaatgaaagcggtgatgatggcaagttcaacgtggctcagaaatgacttgaatgggggctctcaggctcaagtgatgggctggtctctgggttgcaggactaaggaccatgttcaggtgttacctggggttcagggccctgcagcctggggacctcctcaaagctgctctgagggtgagtctcaggaggcaactccaatcctgcaccttcctcttggctcccacatcgggagcagggactgagggcaggctgctgggcaggtctcctggtgtcaggaggggaaagagaggccacaccggacacacctgagaagggaacaaaggttggtagggatgctggaggggagcgtggtcatgggtaaaagaatattgagcaaagaacatttccagggattaaagtttattatatttgcagatttggccctcattctaagaaacttccattagactttagatctttaatacagatcagtatagatttcaaactttaaaattgtctcaattatatagaaggacacttctcaagatttttgatcctaggaccactttataatcttaaaaattcttgaagattccaaagggcttttgtttctgtgggttggatctatcaatatttgctgtactagagattacactgagatatttttttaaatgacaactatgacatattatcataaatatacttcttaataaactatttttagaaattggtgagaagaggatgaattattttacattttttgaaaatctctgaagtctggcttgtagctgcttctgcattcaatctactgtgatgtgttatgttcgttgaagcatatgaagaaaatacaattcgcacagaggtgtagttggacagggaagcttaatagcattttcagatcatcatggctattgctctttgatactctaccaaaatttggcaagcggtggtttttaaagattaattcccatgcagaaccaaaaaccatatcaacagccttttcctaccctattgcattaaaatatatcagtgtttctggatcttttacacatgcatgattttataacaccatgcattggtttttggaaagtatttattcacttagtaatgtagacgttccaaatgttgatgcactccattatacaatacttttgaaaatcacatttataatatcactactaatgtcatccaaaatatctttaaatattgggaaggtgtgttaagcatgtggtgaagaatccaagttttctaaaatcgaattaagacttaaaagctcaaattttaccactggcaacaaacactctcagttgtttcccttgaagtgacaggctcacttcattccttttgagaaaatgtttgtcaaatacccagacaaaaatagtttatcagtttttctttcaagtagaaatgtgttccatgaaaatcacagctgatcagctcatattcagtcccacactggagcttttcttgagcacccaacacacaggtgctttgtatgtttctgccattctgtcacacagaatgttaaaaacgcacaccctcaatggttgagatggaatgaaatgaaatgatttccactgcttagtcaaggacatgctgaagtgaagctgccacgtttgtttttgttgcgagtgttgacggacaattgtgaagaccacaacggccgtgagaagagtttggtgccactgccttgaatcctattaaggccccagcagatttgcccactgttgcttttgtactgttggctaaaaaggcaaataattttttagtgttattctgaaaatagctctgatctcacagatcctttgaaaaagtatcagggatcccaggtgttgttggactgtacctgagatcagttgatacaaaacaatcttatgattactatttatatgtatattatatataatatgtattattttatattatgcatatcatatatattttatgttatttatataataatcctattacgtatgtatattatatatttatatattatacatatatgtattatacacgtacacattattatacatataaatatacatatgaaataatttttcaggttatctagatcttggatctgagtaatccaatcaggtgtctgattgtaatgccctctgcaggctgggtagtgtggtggtggcatgggtgggacaggtagtgtagttctgggagagatccgtctattattcatggtttcactctactcaactctttgaggctctcaactctttttcatcctgtttgacactccacaactcttgcataataataaacagaggtactatagtcaggcaaaaatgaatttaaatccttactttgcttctcactagccatgtgaattgtagcaggtttctgagcacctctgagcctcagtttctgcatctgtgaaatggagataatacaaagctacctcctaggatggttcagagattaatgaaattaaaacctccattgatggagtgacctcagacaacacgttgtaaaagtaagcttgtgcagcctcgtggcccagtgagcacagtgatgagcgcagaaggataaatgaccaccttttggttgggtgctagggtgagcctgctgcatttcctaccgcttttcacacatgcacaatacctctatccaccttggaatacaaggaaataaattgtgtcctgcatctgtttcttcagtcacagttaagctgtgaactctcatggggagtctcatatagctattctaatacatcctcatcactgtgtggcaccaaaattgtggagactttttattaaagattatacagtgttagagtttatcatagcagagtttgcataacatcaaatttctttatagtctatttatgtaccatggaggaaaaccattttaattaaaaagtgggataagctaatttatctcttgaataccaaatgtcttaacctcaaaacccaggctaaggttattcttacaaatacagaatgttttcagaggagacaaaatagtgaattcagtgaatattttgttgtacagtccattctgtattttccttctacattttatttattaagtcagacatgtatattcactttaaatgaaactcttctaatgcttgacttggctacgtttggaaatagccactcgaggttggttcatggagaaagaggtagctggccacacacagacaatgactctccctcaagtgtacacaaggtgctcacatcttcccaaagcctgcttccaggaccccaggccacagtggatgtgagagagacaggatgtcatgttgaaaggcagttttatattgctaaggctcccataacacagttaaaaccaaagatcaaatctaacctggcaaaacgttgaaaacagtttacagctgtttgttagaaaaagttaagccattaactccttagatagccttgattcccgttttctttttgtccacagctatttagtatcttttatggaagtatagaatatttatgtctgaactgcaccaaacatattcaaaaatgctatttggtgtatatataacaaaagtaaacatatgtaagatttctacctgttggcatttgtattaatttacaaacatttatgaagtagaatgctactcaaaaaaattcatttaacttcacttgttggttattggttttattaataaacatatagagaaacaaaataaatgataatatggaatattggcagagatgcacaaatatttacattctgatatatcatttggcaggaaaattttttaaagcaatttgacaaaatatatcaaaagccaaagacagttaatgtcttttgactcattaatttcacccttaattatctataccaaagaaataaaagttatagacaaatatttatgtagaaagagtcaagacagaactttaaaataataaaaaattgtttctctctaaatagcttaatgaagtgactgcttctgtgaatggtggtgcatcagcctaattcaatattatgtggtaattttaaattatgggtttaaataagttttcttaatataggaggcagtcgtataatatagctgcatttttaaaaagcaggatttgaccaccatgatcaagtaggctttatctccaggatgcaaggttgattcaacatacacaatcaataaatgtgatttatcacataaacataactaaagacaaaagccacaggattatctcaatagatgcaggaaaggcttttgataaaattcaacactcattccatttcaaaactctcaataaactaggtattgaaggaacataccttaaaataataagagctatatatgacaaacccacagccaatatcatatggaatgggcaaaagctggaagcattcaccttaaaaaccggcacaagacgaggatgccctctctcactgctcctgttcaacatactattgaaagtcctagctagagcaatcaggaaagagaaggaaataaagggcatccaaataggaagagaggaagtcaaaccagatgacatgattctatatgtagagaacttcatagtctcagcccaaaagattcttcagctgataaacaacttcagcaaagtttcaggatacaaaatcaatgtacaaaaatcactaattcctatataccaacaacagccaaactaagagccaaattagaaaggcaatcccattcacagccacaaaaagaataacatttctaaaaataccagctaaccagggaggtgaaagatctctacaacaagaattacagaacactactgaaagaaatcagggaagacacaaacaagtgaaaaaaaaaatcccaagctcatgtataggaagaatcaatatcattaaaatggtactgccaaaatcaattcacagattcagtgctatagctatcaaactacaaatgacattcttcacagaactagaaaaaaatttttgaaattcatatggaaccaaaaaaagggcctgaaagccaaagcaatcttaagcaaaaagaacaaagctggaagcatcgcgttacccaacttcaaactctactacagggttacagcaaccaaaataccatggtaatggtacaaaaacaggctcatcgtccaatggaacacaatagagagcccagaaataaggtcacacatctacaatcatcttagcattgataaagctgacaaaaacaagcagtggggaaaagactccctattcaagaaatggtgctaggataactggctgaccatatgcagaagattgaagctggacccctttcttacaacatgtacaaaaatcaactcaagaaagattaaagacgtaaaacccaaaaccataaaaaccctggaagacaacctaggcaataccatcctggacacaggaatggcaaagatttcatgaaaaagataccaaaagcaattgcaacacaagcaaaatttgacaagtggaagctaattaaacttcagagcttctgcatagcaaaagaaatgatcaacagagtaaacaacctacagaatgggagaaaatatttgaaaactatgcatctggtaaaggtctaataatcaggaacttaagcaaatttacaagaaaaaaacaaaccaccccattaaaaagtgggcaaaggacgtgaacagacacttctcaaaagaagacatatatgtggccaacaagcatataaaaaaatctcgatatcactgatcattagagaaatgcaaatcaaaaccacaatgagatatcatctcacaccagtcagaatgactttaataattttattattaaaaagtataaaaataacacatgctggagaggttgtggagaaaaaggaatgcttatacactattggtggaagtgtaaattagttcagtcattgtggaagacttgagtggggagagtcagaggagggagaggagcagaaaagacaactattgggtactgggcttaatacctgagcagtgaaataatctatacaacaaacccccataacacaagtttacctatgtaactaaaccttcacatgtaccccaaacctaaaataaaagttaaaaaaagcaggacgtttgaaaagtatatgtatacatatatgtagtattatgttgacaaggctcagaaatcatatctttttagatagaagaaaatgtgcttgttaaaatggttgcttctctcagtattacaattatgaatgatatctttctatgcttttttatacttttctgcatttttcaaaccttctgcattaagcttctattcatttgcaatcagaaaaatataatcaagaaatgtaatacaataataagatatatacatagtcttctgagacttcaaatataaaataatcttgaaatgatgaaaatctttgtcatggcatttttgagaaagggataacagatattctcttttagaaagccaggttgtgttttagagtttgaggagagaaatctgtccactggtcccttttctggcctgggaatggaatcattagttgtgttcagtttttcagacacagccatctttgttttctacttagggtgaccgactttgaaaaataatgcaaatgacatgagattctcggccaagaaaagacattggtcacttagccctgccaaggtgtcctgtctgttccatcacattctaacagggcagcagctccaggggggaggtagggcagtggctgccttctcatgggggcactggttggctgcgggaggggcctcctggccttactgctgggtgttacctgtgctgctgtgacaacagtctcatctgccaggtgcaaaatctgctctatgatgaacaatttaagtgatattccttgtggttgcataaatctagtttaaacagtattgacattttcctatactcacagttctcactttggttttgtaactgatgatgcattaataggtgttgattatagatatccatgtagataagcctatgatttctatcaagattctaaaatagacggactttgcctctagaggtttttaaaagctttttttataaagcaaccagtttaatataaatttcataaaaaaatggatcattggctgggtgtagttgttcatgcctgaaatcccagagctttgggaggccgaggtggaaggatcacttgaggccataagttaaagaccagcctgggcaacatattgaaactctgtttctaaaaaaaaaaaaattttttttttaaattaggcaggcatgctgacacatgactgtagtcttagctacttgggcagacggctgaggtgggaggatcacttgagcccaggagtttgaggttgcagtgagctatgatcttgcacaccagcctgggtgacagagagatcctgtctctaaaacaaatacaaaacaaaaagggctcatttgttttataggaggccaaaagaaatcattgcatgtcttgacttgcttagcacttattctgaagaagaaatattggcgtgaaatgcatgtttataactgggtccttcccatagtagtcttgagcacaaataccaaagttgtttttttttttttttaaaggagaagaaaaggagcagtttcaccttttttatacagaatgtagacaaaatggcagtcatttatgattgatttgttctacctacttagcatgcagggactccccagtgtggtttttaaattaattagttaatttttttctttcattagttttaatggtacaagtggtttttggttacgtggatgaatcgtgtagtggtgaagtctaggattttagtgcacgcatcacccaaatagtatacatttacccaactgctagtttttcattcctcacctccctccccacttctgagtctccaatgtccattacaccactctgaatgccttggcatacctatagcttagctcccacttataagtgagagcatgagtacctggtttttaattcctgagttacttcacttagaataacggcccccagtttcatccaagttgctataaaagtcattatatttttttttatggctgggttgcatttcatggtatatatatcacaattttttctttttgtttttttttagttgagtcttgcttttatgatttttttcctttccaactgttattttaggctcagagggtacacgtacaggttttttacatgggtaagttgtgtatgaaccacattttctttatccattcatggattgatgaggactcaggttgattccatatctttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtacttttagtagagacggggtttcaccttgttagccaggatggtctcgatctcctgacctcgtgatccacccgcctcggcctcccaaagtgctgggattacaggcgtgaggattccatatctttacagttgtgaattgtgctgtgataaacatgtgtacaggtgtctttttgatatactgattgcttcaagaacttaggaactctggagtttgatgcatatatatttacaattgttacatcttcttgtttaattggtcattttatcattatatagtgacctttgtctttttcttgttgttttttgttttgtttttttttttttttttgctgttgttgctttgaagtccgttttatttgatatcagaatcgctactccttgtttttggcttccatttgctggaaatctctttttccaccctttacctgtagtctataagaatccttacatgttcagtggtgtttcccaaagacagcggtgtaggctgctactcacagcttctttcaaagctgtttacggtcctgtgttccttcttggaaaaaagttcacagtgtgaatctctacacactattttatctttccaagtggaaaaggaatgctaacaatgcctatattccatcatcttggaaaaacaaaacaacaagaaaaacccaatgtaaatattatcagcacagaatctttctttataggctccaaaatataccagatgcacacttcatattttatcttgattacatatgccactctttagagtctcagctaactatgactgagtaagaatgtcttagaacacaggctcccacgtccatgagtgcattaaatattcttatttccaaagtggccaggctggctgatagctatgactagttggagagaaagcagcatttatagcctaagtgggctgggcaacaaactacctgaaatccttaggagcaagaatagaagggatgccttgttctctacacccaggtatcactcattgcctgatgtctcgcttcgtgtgtttgctgggtttccgtctgtctaggaaaggaagctctatgggggcaatgactccaatgagtttgtctccctttattcctcaccatgtaggtgtggatttgagtggactccaaatggctgggccaagggccttggataccaaacacagcagaagatgcggaaaggatgagggacccaggggttctgtctttgggggaagagccctgttccctggacattgcctccttatatccctgcactagaatatcgtaaaattcccctagtcaaaacccatgatcctgcatgtcttggagaggctgcctcaaggattcctccttgactccacttattttcatggagaaggaacccctccatccctggcatccttaacagattcccttctagcttctcacccactccatctccaagccaggtttcccttcgcttctagaaataatctgcagtggctgcctaagatgttttctgcgtggaacccaaataaaaatgtaataatttaaattagaattttctacaatcatgtgttgctcatgtctgcattatggatacccaggtcacatgtaggtaagcaattagcaattatggtggaaacaagacttcctaacaggtattttggtggaaacttgaaagctgtttctaaagctgtttattcatgcaaacctcattacagtcctgacagtaaacctatgtgtgcacagggaggcaggaggctgtgaggcagcagcaggatccttcaccccatggctcactcacagtgcactctttaaccaggtcttattatgtccatgcttctggggtgattaaaatatgccctagaagccttgatacccaaaataaagcaaaacgtggaatatgaagtttaaaaatgtgaaataataagtaaaagttttgtgaaatacatttttctatactgttcaaatgatcttgaagatggcatccgtttcttaggtctgccatgcaaaatgaccacgatggagtggcttaaaacaacagacgtttcttctctcacagacatctgaaatcaagaagtcagcagggctggtgccttctggaggctctgagggcacatcagttcctcacctctcccagcctccagaggcttcctcaacccttcacactgctgagcctgtggctgcctcactccagtctctgcctccaccttcacatggcttcttttttgtgtctctgtgccttctccttttctgtctcttatatgacattcttcagtggatttaggacccaccctaatgaaggatgaccttatctagaggttcttactttctttaactctgcaaagactgtatttccaagtaaggtcatattctgagattccaggggttgggatgttgatatatttttgaaggaccacaattcaacccactaaagggatgaaaattaaactgaaaaatatcaacccctaaaaaacctgctttattgccaaccatataaattgctctttgtcacaatatacaacagaggcctcacaaaccttggtgttcttggtgtgagaatggtgaaaaacaagatagaaagcagcctgaaatatgcacaggggtgtgtcatctcgttactgggaaaggatgtactgtccaagcgacaactagactgcagaggtaaggctgagaccagggctgccatggtgtttagattgaacatgaagttagaattcttaagtatcaaaactaaattcatgttcaatctaaaccccatggctatgcctctcaaggtgaggcctctgtgttgttctctatgccttgagcacccttccttctttgcaataaaaaaagttgcagaattgactgggcacagtggctcacgcctataatcccagcactttgggaggccgaggcaggcagatcatgaggtcaggaattcgagatcagcctggccaacacagagaaaccctgtctctactaaaaataaaaaaattagccaggcgtggtggtgcacgcctataatcccagctacttgggaggctgaggcaggagaaatgcttgaacctgggaggcggaagctgcagagagcagagattgggccactgaactccagcctgggcaacagagcaagactccctcccaccccccacaccaaaaaaaaaaaagcttcagaatttcagtctcccacaacaaaacccacacacacacaaatttgtgtagcagctactatttgccaacaattagggtctacacaattaagacatcatctttaacctcaagcagtttacaatccagagggcaatgatggaggagaataatgaggtgtggataaaagtgcctattagcagagtatgcagtggaaagtgtgataacacttctagatagaaggcagttggtccataggtattttggtgagaatctacatgtctgatgcatcatgggctgtaccaaggacaagtcactgcctttggaaatgtttgactcatgccctgatggataggtggataggtctacacatcaaaaatgcatgcctggctacacatttatgagaacaacaaaaattttttaaaaattataacgccacatgctggcaaagatgtggagaaactggatctctcatgcattgctggtgggtatgtaatatggtgcagacattctggaaaactctttggcagtttctcataaaactaaacatgcacttaccatgtggtccagcaattgttctcttaagcatttatcccaaagaaatatgaatttatgttcacaaaaagttatataaaaatatccatagcagctttctttatagtagctaaattctggacaaacagcaacaacaacaacaacaaaatgaatgtttctcacaggtgaatggttgaaaaatctatggtccatccatagtttggaatgctgctattcagcaatcaaaagaaatgaactgttgacacacacaataacctagatgagtctgaagggcattacgcttagtgaaaaaaagccaacttcaaaaagttatctttataaagcattctcaaaacgataaaacagcagaggtggagaataccttagtggatactagtagacaggtacaatgggtaggatggggccaggtgcaaacacagacagataggaataaggaattcttctgtggtgtggaatagttcctcatttgatggtggtggtgggtacatggacctgtaatgggataaagttaaacggaagtatacacctacagagctacacgagcacatacacacaaatgaatgtgggttaaaaataatgaaggtggccaggtgcagtggctcatgcctgtaaacccagcactttgagaggctgaggaggatggaccacctgaggtcaggagttcgagaccagcctggccaacatggtggaaccctatctccactaaaaatacaaaaattagccaagcatggtggcacatgcctgtaatcccagctactggggaggctgaggcaggagaatcatttgaacttgggaggcagaggttgcagtgagccaagatcgtgccactgcactctagcctgggtgacagagcgagaatccatcttaaagaacaaataaatgaataaaagatgaaggcatctagtctactggataatgttaactgggaatgttcccatgtgggtttcctggctctgatattgcaccacagctatggaaattcacaacatggccagaagctaaaggacacacaggactctactatttttgcaacttcctaggagtctgtattgcaaaactttagctttgtaaaagtaaatgccaaaagatatatatgtgcaataaatgtgaatatatacattaaaaagttgtgggagtttggagaagggagagccccttgtaggggtgaggtcagggagggctccatagaggaggtaggacgtgagtttaacctggaaggtggaatgaaatccaacttgaagaactggaggtaattttcagaatggcaaaacagtgccagccagtcatacctggaaaaggaaaaccatgttctcagacctcaaaatagggaatgggggaggtggagaaacatacaaggtatgtttgagtgctggggtggaatgtctgggtaaagaaggagttagtgggtaactggaaacataggttgcagcaagattataaaacgtcttaacttttaagctgtgaaaactgagcttaatctgtaaatagcaggaagacattgtaaattgcaagtgagaggatatcatactggaagttgcatgtgaggaagctgagtctggcagagccctaggatagactggagtggaaaaggaagatgaatgagcgatgagttataatgccatttcacagcccagcacaggcatcctgattatggcttgcagtaagctgatggtcacgggcctagaggggacaagtctaatttaaatgatgctatgaaccttgaccaagaaggaccaggccactgattgccttggggacctggaatccatccaaggaggagcctgggacaggaatagggacagggagaaagcttggaaggaaaggtgccacatttcatctgtctcatgttgattgtaaggggatggtgtgccttccaaatggaagtacctggctgacctccagagatgggagacagcagctcaggagagagtggtcagggctttataagaaataatcgagacagcccaagcaggtcagatcagcaagggtaagagtggaaaagagagcagaagaggaagaacagaaatgtaggagtcttgtgtgtgcaggcatcgccatgcaacgtctatgaaatgagtagtttctcacttcatccagtcttcttcttggcattttgctcaaagcctggcattatactggacaggtccagggttggccacacaccctgcataaccttctcactcatcctcccccactgcttccttaacaacctcctgtcactcactgtcatcaaggcggaagcatgtgcacttcacttcatcaaccatggcaaccagctctgagagtcccaagtggaagacgatgaggggagaatcactcattgtcctcgtggctacaggcagcctctctgagcccacagaacctcacccctacaattaatcctgaatgcgagttctcaaaatagtgcccgctcatttagctgtcagctgtcttgctcttagagcttctgaaaagaaatcacaatagctcagacctcatctttgaggggctgtttgttttgagggctttttccttagttgcatgcttcctattgccagcaaaaatttcttaatcttcctagaggatcagattggcctgttttagatttttaaatgaaaggttaagaggagggaggagtagggcagtgaaagccgcagctgcctctccatatttctgtttcgcaacccaaggggattttgtgtagggctaaatggaaccccctacggataacagttatgtcaggagatctttctgcatgttctcgtcatactcaaaatgttccttcacatgtaagttagagaggacatgttacttctttccccagctgtttcctggtgagtaagaactcctgaccatgtgagaatatgagagcatgcagcactccaagatccttggggaaaacaatgaaagcaacagctcagtgagccattctccatgctcaaccgaaaaccctttgagattcgctgccactttctgtgacaatggaattgtggcccggtttagcccagaaatgtgttgcccaggctggagtgcaatggcgcaatctcagctcactgcagtgtctgcttcccaggctcgagctattctcatgcctcagcctcccaggtagctgggattacaggcacccaccaccacacccagctaattttttgcatttttagtagagatcaggtttcaccatgttggccaggctagtctcaaactcttgacctcaggtgatccacccacctcagcctcccaaagtgctgggattacagataagagccaccatgcctggccagtgctgctcaaatttgaaccaggaatatttgttgatgggaacatacactaaatctattactccatggattccatttttattccattgataatgtattataggtattattaggaactaacttgtgtctccccctaaaattcgcatgttgaagccgcaactcctgctgtgactgtatttgaagatagaggcttaaagaggtgattaaggtaaaattaggtcctaagggtagttctcatctaatctgactggtgtccttctaagaagaggttagcgtgtagccacacacatggaggagtgaccgtgtgaggaccccaggtgaagatggttatctgcaagccacggagagaggcctcaggaggaatcaaccctgtcaacaacttggtcttggacctcgagcctccaggactgtgagataataaagtcctattattgaggccaatccatgataatttattatggcagacctagcaaatgaacacagatctatctttctgagactttacattatagtttttgtgttttaggggctgaataatatgccacttatagatgtgtaattactttttaagtaactgtgaacatttatgttgtgcctaaaggctcctataatcaataagattgcaatgagccatccttatacataaactatgcacatttatctaattaatttcctaggataaaatacaagaaaaggaattacagggtcaaaagatctgctcacacaacatatttttacacctggccaaactggcttcccagaagactgtaccatcagacatttccattgcaagactagagtgccagcaccccagtccccacctcctaccaaactggacactttcagtcatctgctctgcaatggcaagaaaatttcacagaaattaaagaaattatagaaagaatttgaatatcttggtattttaatattgaaatttccatttgtttaatgaattctctatcctttttcactttttctgggattgtttttagtatttataaatttatgttattgcataataatacttttttactatagttacaattttttttcggtttgactttttaaaaattttgttttccatatttatttgtttgcatgtttattgccatacagaatctttagcaggatgcattgtcaaatctgctaagcactatctttgtggtttctatcctggggtatcatgcatgcaatgtctttcttttcttgaaatggaaaataaatcacctaaattttctttaaattgtttttgttttgttttgagacaaagtcttgttctgctgcccaggctggaatgcagtggcatgaacagagttcactgcagccttgacctgttgggcccaaggggtcctcccacctcagtcccccagctagctgggactacagtcatgtgctaccatgctcagttatttattattttatttttgtagagatggggtcttgctatgttgcccaggcttcttttgaacatttttttttttttttggcaaatcccaggaaaagcaaggattagaaatgtttactaccacattattgggatttttaaaaaataaaagcagagttttaacttacttgatataacacatccaaatagctatgtggaaatggcccaggaaatatggttgatgctggaggcacccattcctctcactgggtctcaatgtgtgccctcctccaccacctacccagctgtaccattgtacctcaggaacatgtagaatgtgcagcctctggagtcccccctagacccactgagtcagctccacaggtcgggcctacccccgtgtgctaacatgccctccagaggatgctcacagcctctgctctgctacccagagctgcctccttgacccctggcctcaggtgcttttccccagcagtttccagtggattcatcctcacatcctgttcctgtcattagggacacacctactgggatgaaggtattctggtgacagctcatttgctattcacacaggcacacacagactcacacgggtgttcaaaggtctctttacctagacgcactgacattactatccttagaactgggtggagttcagagagatacagttagagcacaggttacacgttgtgtcagatttcacagttccctctgctttgggcatcccaggctctctaagaggaagcaggtgctgctgccaatgccaaaaagcctctgtgggtgagatagttccatgtcgaatataaaaggccaaatgtggtaaaacctccaatacttattgcataaatcctccctaaatgggatggagagagcagtgcaacaatctttcttcaggagaaactataggtgatgcttttaaacattatttactatccttgaatgtttttgaaacatgcttaaatatcttatatgcctgttttatatgtgcatatggggaaatatacaatataatattcaccgaggcaaagaattggggacatgatcaaggagatatttttaatacttcaacagatcattttttgtggctctttagcttgggaccttgtgctgtgagaggcacaagtttctgtgttcaagagaacacttttttttttttttttttttgagatagagtcttgctctgtcacccaagctggagtgcaatggtgcaatctcagctcactgcaacctccatctcccgggtttaagcgattctcctgcctcagcctcctgagtagctgggattacaggctaccatcaccatgcccagttaatttttgtatttttagtagagatggggttttgccatgttggccggtctggtctcgaactcctgacctcagatgatctgcctgccttggcctcccaaagtgctgggattacaggcatgagccactgcaccaggcccaagagtacacttacttgcatgaaggagcagtgaatgaaacctgctaaggcccccagcatgcactgcttggcagcactcatcttccttggagctgaatcttctagcaggtttctgcttcatttagagccgtcaatacctcaattagtgtctgttcgtctcccctgggagggacctttacacatgtctcttcatgagcctctgaactttaaaaaccccctgagagttgctgggtcataaaatacctcctgattaacagtgctgtttgccaacaattccttgctccttccatttcccccttcttaaagatgtatcaactgacataaacagaagacacagaaggggtgcagcctgccaacagttacatggaatgtattcctgcaaatgtgccatgcatctgtttacccatttcactgctggatgcagggctcataagcccataacacaaagcaggaaaaagcactggttttagttgcacatgtgactgtgtgtgtgcatgtgcagacacacttgcttgtgttggcatttactcgaaagctaggatacgacctccatctctttgtatcattaatactacagttcagttacatgagaagaatctcgcccccactttgaattatgaaagtaaaggcgctggttctggcttccacaggctgggtgtattccttattctttcagaagaggtgcttttctatctgcaaaaccattggtgttattttgtatctccatagcctctctaagtcagttgtcccttccacaaacctataaaataggccaaggttatagagaccatctgagaactttaaggttttcctttatgagaacgttcttaaataagtaagaaatatatagttgtatatttattttctaataaacataataaaaatgcatcatcttggctttcacacaaaatttgggagaaaggtttcaagataattaaaagtctttaggagccattgccctctagtcttccagcagacacccaggcaggtatgaacataaacacacatccacatccacgcaaacacatgcacacaggcacacacaaaagaatgaatgtacatgcatagaattgcacacgtgctcacacaggcacattcatgggtacatgtgtgtgcacacacgcacacaaatatgggccctacaattaatctgtagcagcaatctctttgaaaacaccactgggaaccctattcttggaaagtaagcagaccatcaccccattctcttcaaaacaagttaacaaaagttagcacttaaaacacccctgttttccttttatcttttacctatgttgttaatattctacgtgatatgatggacacaaccgttatattatttatcaaattcattaatatttcatttaaaacctacataagtgaaatttacttttaaacatattttatttattgctcaacctttataaaaaccacattaaatatttaaaatttttaaatctgtatgatcccattatcttaacactttttttcttacaatccttgcctatacatatatatgaaaagctctttagccgtacaggaatgtacaatgtaattagaaaaccaagtcatgaacacaaatattaactagaaaaaaaactaaccttataagcactttataatctacaaaggtctttgcatgtatttaattgtgttgcttctctctattgaggtgggcatcacccttgcacccatttgatagatgattcagaacataaatacccacctaattttatagcttatcaattggcagagccaaaaaacctcaaagttagctctgctgattccaaagcctgagctgcttctgcaatatgcacgcagggtactagaaaacaaggctctgggtgacgggtaggggagggatgccacaaagaacagatgtaaagcagcccccaggtgggggatgattcagacaggttgtgggaccccagagtgtgcatttctagcatgttcccaggtgatgctggttcagggctgtataataactctgtgtataaaaggaaagaaacaacaggtactatacatgtatggtagatatctgcaaacataaggtggaaggaaagaagccagacacaaatgaatgcagaaaggttgatggtattttacatacagttcaaaagcagccaaggatgtaccaagttgttcatgcatccatacccaggtgggaaacagatgggctgcatggtttaaaattctggctccgctcctctctacctgtgtgatcttgaacaagccatttagcctctctgtgcctcaatttttatactcatatttacaaaacctccttcctaggattgctgtaggtattaaaagctaatacatttctcagcagagaacttaatgcatattagctataattatcatcctcattattacaccagatgtttttaaaagggcatttatgtccttgatactagcatagtcaaatgaaaaaggaatgaaataaatgatacaatccagataaccaaataaaaaaaccatatgggcatcacatgcaagccaatggaatcatgccactaatgcttgaatgaagaggcacagtggaaaatgaatattaacacagatgaagatcacatggtcagagtggtttcaaggaaaaggtgaaactttaggaatcagaaatatggtggagattataacgttgaaggaaggatcaaaatactgggcgttggcccattttggacaagaatcttcaggtagaggagatccctgggacaccctaaagagctattagcttgtaatctctacagcaaccctaggagggggtgctgtaattataggtacagaaattgaggcacagagaggccgaaggacttgttcaaggagataaccagcccagcttccagaagacacagcacactgaacggctgggagccacaggcagtgtgctgtgcagtgggtgatggagacaagacatggtagaattcaccaccccattgagtgctaatggggatgatgatttatcttctctgtttctccatgaaaaacagctgtacataaagcagctgctcaaaagttagaacatggcttcagacatgacaactctgtgtctgtccccaagccacatggaaactgcttgccttctgggaaatgcatctgaatataagagtgaagggtggcgggggtggaatccaccccccagctcccacacagggttgttggcaggctattggcccaagacttgtccttctcatggtcctctccataggccacatgggtatcctggtgatatcatggcaggcttccctggagcaagtgatcagacagaaagagagagaactggggcacccaagtagaaggtagaagctacagtccttttataatctggtctcagagtgataaaatgtggagagtttgaattccaggagatgagattaccacaggtcaccttaaaaactggctaacccatggctcataatatatttttgctgcaattaatatcctggacagcacttacccaatttttcaggatgacatgatctattttcttccttgtttctttatttttttactatcattgatggcaggaaatcaaaatctatttactattttcctttttctacataattattaagaagttttctgctgagtacaatggctcatgcttataatcccagcaatttgggaggccgaagcaggcggatcacctgagattgggagtttgaaaccaacctgaccaacatggagaaaccccgtctctactaaaaatacaaaatcagccaggcatggtggagcatgcctgtaatcccagctacttgggaagctgaggcaggagaattgcttgaaccagggaggcagaggttgcagcgagctgagatcatgccactgcactccagcttggtcaacaagagtgaaactccgtctaataaataaataaataagaagctttcttattgggcaaaatatagtacctatgtacagaaccagacagatggaaaaaaaaaaagaaagaaatggccagcctgcctccatgcgagttagaggaaaatactgtttttgatatcttttggttaatattcatacttgtcttaaaaaataaatcaactttcttccaataatgtgacttgaaataacttcagagtgaatgtaatatgaaccctaaatgttcttcgtctttcccctgacacattcaatcatgtcataagggcctggaaaagctgccaggaagtggagatgttgtcattcttgttcaagcttagcatcaaatatgacccactccagcttggaaacatgaatttgattaacggttataatctaagtaacttcattatgtaagcataataacccagctgaggagatattttagtatgtgctaagaatttgttaattcctggctggaaaaatcattttctttataaggattagagctgcccagtaggcagcctcacttgccgaaatcttatgaacaataagtatttggacaggagaaatttttgattctgcagcagggataatcacacttggtgtttctgtggggccattcttccaacaccctcagagggttcctctaacataatctcattaatcctcattacagccttaggaggcggcaggtctcattgttcttacagatgaggaaacggagatgaaactgagaggcagagaccacaaacagggaaaatactgcttggcctttgaatggcttgagaagaaacaggcaaaaagactcaagccattttctctagcaaagttctacagactctaaaaaataatgttttgtacaccagtgttcacaatagccaaaaggtgaaagcaacacaagtgtccgttgacagatgactggattaaaaaaatgctgtgtacacatatcttgaaatataattcaggcttagaaaagaaggaaattcagacacaggctacagcttgactgaaccttgaggagattatgctaagtaaaatgagccagatacaaaaagacaaatactgtatgattcttcttataggaggtccccagagaagtcaaattcatagagacggaaagtagaatggtgactgccagggcctgggggccaggaaaaggagagaatagggattgtttaagagttgccaagtttcaggttgggaagaagaaaaagtttgggggatgaattgtagtgaaggctgtacagcaatgtgccttgcagctgagaaaatggaaatttcaaggactttatggggagtctcctgtaaatggactcaggccccagaatgaggggcttccaagggtgttctgatttgaagacagactaagaatgtactttgtccactgaaagtgaccaaaatgaccaattttttgttatgtgtattttaccaaaaaaaaaaaaaaaagaatcctgaggacagcaagtattcgctgtgactgggaagatactactgtgggtgttttttgttttttgtttttttaattttactttaagttccagaatacatgtgcagaatgtgcaggtttgttacataggtatatatgtgccatggtggtttgctgcacccatcaacctgtcatctaggttttaagccctgcatgcattagatatttgtcctaatgctctccctccccttgccccacccaccgacaggccccggtgcgtgttgttcccctccctgtgtccacgtattctcattgatcaactcccacttataagtgagaatagtcagaatggctattattaaaaagtcaggaacaacatatgctggcgaggctgtggagaaataggaatgcttttacactgtgggtgggagtgtaaattagttcaaccattgtggaaaacagtgtggtgattcctcaaggatctaaaaccagaaataccatttgacccagcaatcccattactggttatatacccaaaggattataactcattctacaataaagacacatgcacacttatgtttattgctgcagtatttacaatagcaaagacttggaaacaacccaaatgcccattaatgatagactggataaagaaaatgtggcatgtatacatgatggaatactatgcagccataaaaaagaatgagatcttatcctttccaggggatgaagctggaagtcatcattctcagcatactgtgggtgtttttatggctcccaggtgatgtaaggaatagggaccacaggtttaatgaaagataatcgtgatgtattgagtggcttgggaagatgttgattgcaagtggattagtcacttccctcattaaggcttgcctctgtacccattgccttcatgatgggcagagtgggctccctacttcagattccagattgtggttactcatatctaagtcttatccaagagactgccctctcctcagctcttcttattcccctcctgctcaaggtacctgggctgtttctttctactggaagcagtagaggctgcctaggaagtggagtactgtcctgacattcagggacagcatcatcggtacaagaccagtccagtcccacaagccaaagattatctgcagccgccatcttgaattcttaacaattttgtctttgaaattgtgttttgcaagtgaagtccagtgtgacaatggagcatgaacagggtatgtggagccacagctcccatgtcatcccacctcccactgcctctccagaataggttttcagctgttcactttcctgccccctggagccccaggctcccctttcctgcaactgcccagcaatggctatggtcatccagtccatggggatctgggtaagtatgtggagaaggtcagagacagcctcctgtaacatttctgggtgtggcacccctccctgcttctaggtggcagtaccagagagtttacagaggatgaccgggcagggtgggtctccaggtcactgaaggtcacctattcgactgagagaggcctgactacacgtccccaccctggcctgggtatgatgatggtggggatccaggcatgtggtggggcacatgagtgtgcatgccaagtcacagggctgttactgggagttagggagggtcagcacttgaccagccagtatcaccatgccagaggaagtgggatattaaataaaaaataaaggccatcatgacagagggagagagggagaccacagaaggaaggaaaaagctttatattttagaactttaatggcacctttttcctgctttttgaacaaaagcctccatattttcattttgctctgggtcctgcaaattgtgtagccagtctcgtctgcttaattctacaaatatgcaataggcttgcgggagatgtttgggtcttgccttgcagctgagaaagtggaaatttcaaggactttatgaggagtctcctgtaaatggactcaggccccagactgaggggcttccaagggtgttcaggcttgaagacagtcaggctgtcagatacccctgtggtcagacactctgcacccttggcctcctccgctactataagggaaagaggctttgcacttggaatcagaagacctggattctccttctagatcttccatttactagttgtatgactttaggctaattacttagtttccccatcctaggtaattataggtaaatggaattaagaatcccttctccactgagaaacacatgtgttgctgcaagctcatgatatgaaaatgatctgagacgtgaaaggacagaaggacagatgcgttattaactaactgtgctgctactaccatttagctttccagaccctggaggaaggaaggaggaaagagaagggaagagaggggatgggaaagattcatcactttagggattaatgaagatcattttactgtattacttttatggtaatattgattttttaataaacttactaaataaaatagaactttgcattagggataggagagaggcaaggggaataggtctagtcatttccagtcttaaaccccctagttctctgtttccttacttagaaattaaggagaggctgggcgcggtggctcacgcctgtaatcccagcactttgggaggccgaggtgggtggatcgcaaggtcaggagatcgagaccatcctggctaacaaggtgaaaccctctctctactaaaaatacaaaaaattagctgggcgtggttgtgggcgcctgtagtcccagctactcgggaggctgaggcaggagaatggtgtgaacccgggaggcggagcttgcagtgagccaagattgcgacactgcactccagcctgggccacagagcaagactccgtctcaaaaaagaaaaaaagaaagaaagaaagaaattaaggagaaaggggagaagatgtcaagtagaaattaattccaaaattctcttatattctaatctttatttttgcccatttaaaggcggtgtttggtgtctggtttctatttgaccatctgcatagacctttgttaatatagatgcaaatccaattaatctgctggaaatgttttgtctatgtgtctcacttctatttatagcataatttagaatcaacttaaaatagtactcatgtgtcttgggtcatttccatggctagtgtttttattccatcatgtcgtatggctgaaatacttatgcagtatatggaaaagttcttagcacacagtcaacactcataaaaattagctattgttgttattatggcactgtgaaggagaaaacagaaaaaagcaggagacagaaatagagggaggatgaaacagaagaaagagaggggaaagtgaagaaggaaggaagggaaaaatgaagaaaaaattgggagggaggaacagaaggatagagggaaagaaataaagaaaaaaggagaaggaggggaaatggcaattagtgggggaaaagaccttggggatcatcggattgagttgtttcaatccaggctgtatattttaggatcgtctgggaaacttaaataaatccatgcataacccccacccccagggactctgagccaacgtgcggtggggcctgagcactggcctattttaaaggcttctaggtgattccgagatacaggccaggttgagagcccgtgatcccattcagctcctctatgactcaggtgagaaagccaaaacccaggacggccaagggtcctgcccagtcccagcggcaggaggttggagtcagattctctgctcccaggccccttcctcacctttccttttggtaagacatatgtgaggggcaccactctaccccaggcaccacctaaccccacatcacctctgcaggccagggtgcggcagttcctttacctgggacaccaggaggccagtgggtctgcaccctgagctgcagaatccaggcaggtggctgccatcttacagctcgacctttgagacccacgctgatgtatgtgtttacccaaggtagttttaaaatagaataataaaaaaaatgtattcagtaaatcttgataacaaagaaaacacattttgattcaacactgtgcattaaagtgtgaactgtggaatccaggcagtagatacatggctgattggcttcctgtatgtttgaaattttttcataataaaaatttgggaggactggtttaaaagggacttgaaaaaatagctttaaaatgtgtttatgtcccagagcatctccttcttttgacctcccacccgggaaccctgtaattcctgcctcagtttcccatcttgggcattgggccaggtttatgctgcctcgttcttggctccacaccctcctctgccatatctgctctgaatgcctggagggactgagaaacttcccaggatacagacttcctgtgttaaaacactggaagtcctggacaccctgggacagttggccatctcctatgtttggggtgatcatgacgatgatggttttcaaataggaccgatcagagtcagatcctgatggactcctgtatttgggcatttgacaccctttcttctctataaaatgaaagtattgagccagatgcttgtgacaggaatcttgtctcattcgggattatccaggctgtttggtactttctcctgttttcttttcagttgttttcttttcaatctgttttcttttcagcagaaccaggtaggaacaaaaaccataaaaatgtataaggattaattttgcattattgatagagtcattaaaagacttgagagtaaagtttggaaccagtctttaatatcagtgatttattgatagaatttttcattctctctgtatcctagggttaaaaaattaagatattcatcaatttatcactgaattacttgtcaaaacgtacagtgacaaactgttcatattttaattatttaattaataaataagggtttactttcattgataaagttaattattgctcttagcttaatcttactatcttctcagtatctcttgtacgatgggaacaccctttaaaattattaatatagtgaaacactctcctaagtattattctggtaaatgtttaacaattagctattgagggggagaggatggagaaagccgtgatttctagcactcgccaatttcagtggtataaatactaccaccattgccaatttcaagctaaatgggaaagagacatgactgcactgccaagctgggcagagatgtgcacaatcagatctccctggccaatgacagcagctccactacaccactgcatctttatgctgcaaaaaagtaggtcagagggatgctcccttatatcataagaacacagatttactgagcattaaggatgctgttagataatattatagtttatgaagcaaatttataaattgatatgatgtaaaacagcaccttcctcaatgggtaattttgcaagagaggcacgcagcacacaacctttggacaaagccttcttgggtctggatctcccttggccctgctagcagggtttgcccacagcctctccttggtaccaatccctgttaaattaccccatccatttgttatgcttcagaaatcctcgcaaaaagggctgctgtacagacatgttgtcatctctaggcatccataactgtgacaagtgaaaaggtcatgccttcaaacattagcattgcaaagaagccatggtaatgattcattttttcctttccaccattactttaaagggctgaaaatacttgagctggataggagaacatgggctagtcagagcatttctctctaagtgctgaatttaataaccagaacaaaaatacccattttagtagggcactctttcaaagtagaaatctaaataaaactgaggagtattgtgtgcagattaagatgggcaagtcataaacaaaccagaggtctatggtttggccaaggtacttctctcatcaaatgcgataaaacttgtgattatttttttaaaaaaggaaaagagaagaaaacaaacaagtcctcaaaacaatgctgcagtttttggagaacagttcttccagttggtggttttaaagtactagggaattacattctgggtcaacaccagccttggagctcctagaataggacagaaacccttacttcagaattggcttgctctcattggaatatagtcagtgagtgttaaactaccctggatttgggaggtgatgatggtgacttaccaagttctcaaaggaaaactgtctgtttttatgtcttaccattttatacatttcctttttacaaacactgcaaaataggaaatcctgaccatagccttgagatgcccaggagactgggaggcattaaacatggattgattttcagttttgcaacaagagtttctatattttattctaaggatgagggtgttgcaggaatcaggacactcatcaggaattggggcgtgggggttgatggtagtggacaggggtcacctttcaaagctaaattatatgtgggtgtcatggtttctgattcacattccccagtcgtgagagaaagaatgaggagtaaatattttcttgttcataggcctgtaatttatttattcacagttttgtaatttaggttacttttgttggctttgagatctctaattatcttgagttagcctctttcccgtatgagaaaaaatcttgattagtggattgaggccaaacagaaagtgccaccaccttcagttcctctgtgatggcagatccatggtgagcctggggtttctacagccagtaagcctccagctgtcgaggaacatgccagctcacctttttataggtgcacccaatctctactctttgagttcccctgttgaattcaaatggttgaacttaaattgttgaactcaaatggttgaaagggaatgttcttgttccctcaccataaatgctgaatcttaacacctcctcttattccctcttctctctccaatctccggccacaagagtgcaaaatggtgctgccacttggtcaaacagtgtggcagtttctcaaaatgttaaacatgaaattgccatataacccagtagttccacttctaggaatctctcctggaaaaaaatgaaaacatttgttcacacaacagcttatacaggaatatttatagtataattactcataatagccccaaagtagaaacaaccccagtgtgcatcagtgggtgagtggatttaaaaaaatgcagtatatccgtgtgctgcaatatcatttagcaataaaaaggaacaaagtactgtgctatgacatggatgaaccttgacaacattatgcttagtgaaaaaaatccagaaagctagatactaaagaatacatgctatatgattccatttataaaaaatgatctaaaaaggtaatacgggtattgtgttagtctgttcttttaaagacataccagagactgggtaatttataaaggaaggaggcttaactgagtcacagtcctatgcgactagggaagcctcaggaaacttacaatcatggtgaaaggggaagcaaacatatgcttcttcacatggcggcaggaaggggaagtgcagagtaaagggcggaaagcccctcataaaaccattagctcttgtgagacctcactcactatcacgagaccagcatggaggtaaccacccctatgattcaattatctcccaccaggcctctcccatgacactatgggagacgaattgtatttatggaaactacaattcaagatgagagttgggtggggacacagccaaaccatatcagggagagaaggtagattagtgattgcttagaacttgagggggaaaagagaaatgactgcaaatgggcaggagaaatcttttggggtaatgtaaatgctttaagatttgattcagtgatgattatacaactgtgtatatttgtatacaggttataatggtatatatgtatatgtactggataatataaatatatttgtaatgggttgaatagtatccccaaaaattaatgtccccttagaaccttggaatatgaccttatatggaaatagagtctttgcaaatataattcgttaagaagagatcatactgcattagggtaggtcctaaatccagtgactggtatcctcataagaagtccatgtgaaaagacacagaaacattcaaagaagaatgtaaattatgtgaagataaggcagaagctgaagttttgccgccacaagccaaggaatgcctggggccaccagaagctggaagaggcaaggaagggtcttcctctagagctcttagagggagcatggctctgttgtcgacttgattttggaattccagcctccagaactgtgagagaagaaatttctgttattataagccacatagattctagtaatttgttacaggcactctaggaagcgaatgcaatattaagtgtacaactgaattgcacacttaaaacaggtgaattttatggtatggatattataccacaataaagctattaataaaaataaacatttttatttattttataggctaggggaagggggggatcagaaccaaaggctggggacagtacagccagttttgctgcatctcagaaatgccagaaaaggaatttcacaacagttgtgagcaactgtccttgatatgcaggactcttggcacctctttcttgagtcaccaatttgcctactttccatcttattacacggtcagtgctgtggggcacatctctgccacatggctgctgactctagagaaactcccaaatgtaggttcttctgtgggtgttcaggctacggaactggtagtattttgacgtttcattatatgtctcaaacctctctagtaagccatgggaaaagacatgacccagtatgtgccagtcttagaagaagccacagtgtttctatggtcaagtaccttggaagtcttacgaggcaagcaatcaagtacgtagtctgagcttgacctcagaaatgggggaagggagcttcttcctgtgattggggaaatgagataaaaagcaaataaaaaggttgttatgttttgatgaattttcaaacctttctagtcctttttgttaacatcttgttcctttatcatatttttaaaatatctttaaacattcttgcatagttattttgcagtctgtatctgacaactgtatcatctgaagtcctgggaggctggttctcaatcatggtgttagttttctcatgtgttctttagtttcagtttgtgagctcacggccagcagggctttatctgggtgcatttcagtgggcctggacagaggacacattcttctagagtatgttagcttttgctaggctcctcaggccattatcaaattacggtcaccttcatgttaaagctttagcatgaatttgactacagacctatgtagagtcaggccagttttataaattctcaggggagagattgtttttctacatatataacacaagctgaggcagctttcttctctctttgcctttgtggatttttatttattgttattattattttggttatatactttctgtcaagatagaaccctttgaggagcctggctttggaggtctcatatttaatgtcatgcctctcaggtagtcaaagcaccgccattatatattacctctggcttttcactatcagcttttgtgtttggtctctggtttttctctcactttctgataagcttagtatgcattttaaaaggtgtttgtcatatgcagtctacaatttataagtggcttgtggaattggggtgggatcttttgtcatctattgccaagaaaagaagtctatgtattagacttcttttaattttgatgtgggaaaaggaaacttgagaagcttcacaaataaagggttcccttttctcagtaaattggagacgagattctctgctataagttatggaagaaggacaggtttgaggtctccagtgactgataaaggtttgcaaggtttataacaactgtgggagatgggcattgtgaaaagtggttacaaggactggttagcagcaacaagggattcacctaaagttgactaaaagtggaagttttatccccattgtttataatgatagttagaaaccagtaacatcattgtattagtccgttttcatgctgctgatacagacatgcctgagactgggctgtttacaaaagaaagaggtttaatggacttacagttccatgtggctggggaggcctcatgaccatgatggaaggcgaggaggagcaagtcacatcctacatggttggcagcaggcaaagagagagcacttgtgcagagaaaatcccatttttaaaaccatcagatctcataagacttactcactatcatgagaacagcatgggaaagatccgcctccatgactcaattaccccccaccaggttcctcccatgaaacatgggaatgaattatgggcatacaattccagatgagatttgggtggggacacagccaacccatatcaatcattctgggtgtgctaagggacataggccatagccctcaacagggttggaagagcaacgtgccgtggatatgaaacggcatggcaatttctgctgagggctcacttactcaagtttcatttttctggtgcctttcctttattttgctcgagattctcatgcagcagtttcttgaataaatttcattttgaagaaatatctcttgaagcatggtttacctgagtgttttgccagggaaaatcaagaaccctgctttgctgaacaagttgtgtcccttttgctttttcagttcctgcgatgataacatcctatccaaatactaccctggccacgcaggggcagaaaaaggagatgagctgcacggcgcatggtgagaagcccattatagtccgctgggagaaggaggaccgaatcattaaccctgagatggcccgttatcttgtgtccaccaaggaggtgggagaagaggtgatttctactctgcaggtaaaagcatggcaaatacaacacaatggaatgaactttattggaagaataagtctttcctttcacagaagcgggtgcagataagtagcagataatctttcggaatttatttacgaagcactatttctctcccctttcacacagcgagattagtgaagtagccttcaaaaatagtgcttcagcctaagtgttattaagaatagggttattatgaacgcagcagggaacccaaatgtagtaaaaaaaaaaaaaaaaagtgagaaataaggtttttaaatgacagttaatccttcaggaatgatggcctatgctgtgtgcatgttttaacttcctgcaaaaagaaaaatgagatgggctttgggacaaaaatattatcataaaaactatcttgcttctttggaaaaatccacaataaaaaaaaaatctgtcgttaaaagaggatcacaaaagctagagaaaaggactgtgagcagtgaactggtttgtgctgttgtcatgcggttggaggatgatactgtagcacacacagggtggggaggtggggaagccctgtgtttgaaatgcttatattggctctcagacaagggtccattcctggaatcctcctagaaaaggaatctgatgcgagtcttgcgggcccccagccctgcctgcagtatttaatctgtctctttaggcatggttgctttggataccatgaaaaaaaaaatgtatatgtgggatatatgtcaagctgaccacgacatcttatataaattacacatccaatttaatgagctacacctgacatggataatgtacgtgaatcctatccatccgcctactttcaattacactgaaataatttgtcctcagagggatacgtgcatgtgtgtgatttagtatgtgagtctggaggaatgggggttttgtgagtgtgtgtgtgtgtgtgtgagtgtacctatgtgtgtgcttggcatggcaggagaactgaaagagtggagagagagagctttacggctcaaagtcattttgcctactgaaaaagatgaatttctttctgctttacacatagattttgccaactgtgagagaagattctggtttcttttcctgccatgctattaattcttatggggaggaccgtggaataattcagctcacagtgcaaggtaggaagacgatagcgtaagagaataaacacagtcatttcaggatgggagctgtatgctcagcctcaggcatctctgtgtcctcaacttgccatgtaacacttcctaattcccaggaaattttgaatatgtataatgtcagtgctaaagcagaattttgcagtgcctgggattatgtcaaagtaaagcccccaaacagggaacgaagcccttagaggaaccagtcaagatgacaagcccatgacagtcaagccacatgcacacaagtacagcggtggaatttctttgctcaattttaggaatccatgtactagatgaccagaatgaaagggaagtttaacatttggggccaaaatatgttttgagttagagatccaaactagaatcgtgacattttatatcctccaggcttggtccagttcttaagggctatgaaaattggaagtcttgggaaagtggaatttctcttccctaaaatgtgattaggaaaaagaaaatgcttccaaataaaaagcttctgttcttgtctaatgcagacaaatcgtttgtgagtcacgctcagcatttccactagcgttttatgtcagagctctgtttgaactaactcgtagtctttctgttgatggcacagagcccccagaccctcccgaaattgagatcaaagatgtcaaagcacgcacaattacgctcaggtggaccatggggtttgatggaaacagtcccatcacaggctacgatattgaatgcaaaaataaatcaggtaagttctttacttcctccagcttcccttccacctcagaaagttcttttatttttctccttattaatgtgttttacctgtaagcgcacagctcagctcacaggagctcagagggcaccacttcccccagtctccttgctggaagcacatcctggctttctgctgtgggagtggagtttcgtgttgaggctcagctctgcttctttcttttttagccagcccagacttcagtcttgcttcctgctggactccttgatattgcagcttcctgttggcatgtgggcagtggctgatggagacaggcccccaccatgaccttttctatttcacctgctcccttcacttcccgtttcccgagctgggtgacttttgtagagcctgagcccatgtcctgcacccagagcgttgagctcaagctgtgcttggtgttggtcggataaactgtgcagtggtggttggtgcagaaaaaggaaaattcactctggagcaacctcctggaaatgctcagggaccatcggcgacactggctgctgcacccaggaccactcggcccagagcccataaataaaactgaccctgctgccagggccgctgcaggtgtgcccattcattgccttcaaggaacaatgcccgggccattttgaactttatgatgcattgggcgagggtagaataccaccacagtggcctctagtcagaatttttactgtgtctcataaaagatatgaggaattcgagcaccaccagcatgggaagggttaataaaatccttctaggccgcaaaagcagctttatttttcacttcctggataccgcacgttatttcagattacccagttgtgacccatctaatatctttggcactaaagctgtagtaaaaaatcaagctcaaggcagctgggaaccacaggtcaggagtgaggaaatgtttcagcaagagcaagccaggaacagagccaggaaatggtgactgcaaaggcaagccgaggggtgactcttcgggaattcaggagaacagaatttgaagattgagaagatatggatcaaaacaaaaaatagtgttttgaaaagtagtatctgtgactgctgggttggaaatgcacatgaggaaagatggaatggctcaggtcatcggcctctgagttgcaactgggggcctagaagtgaggtgtcacttacacaaagtctgaggaagggccttccggggttgattggactgcaagtctcaccgtagccaagaaatgctgcagagccagggccctgggctcaggggtgaggcacagtgacctggggggctcacccaagacagtgctgagctgaacaagcatcttttggggactaggaccaacaggtttcccaagggcccagggaggagaggctgaccttgcctttcttacaagttcatgtatacaggtcttgaagtgaagcaaatgcttcttaggtgaggcaggcacatttgagcagaaactgtcctggaacttagtgacagtgatgagagctcagacagatgcagtgagcaccgtggggacagggacagccctttatctcactggctgcgcactggctatggggctgcaggctgcccatgctgttggtgcgggagcacacaggagacctctcctactggagcagcccaggacctcccctgtcctcatggaggagcgggcattgccggatgctggtggcaggcctgggctcagtgatttgggacccagcctgtgtgggattcgctgctgggcctgcgttgcaccagctctgcaccctcgcttgcgcatctcacctgtgaagtgggcactgctgcatccacctcaaaggactggcaaggagaccacaaaggccaccagctgccctctgcctggagtcctcccttccctgagccacccagttactaccccctccatagatctcaattctcaggtgctcacccagctccttctccctttcaatctgggcaggtggcattatgggtcactatatatgtatctctatgattactgacaaatatgctgattaatgcatttcacctccaccacgctagaggctccttgggggctccctgcacctagtaggtctattttcacccagctcatttctccaacacccagcaccgcacccaacatgtggagacactcaatggaaattggtgaactctaagaagggaagacattgaaaacgccttcctcgttgtctggagcatactcaacatctaataggtggtagcttgtagattgctccagcatgcaggaaaatacttaggagtaaaatgcctctaaaaccctctgtgttaaactacttactcagcatctaagtgtcctcactatctccctactcttacccaggagtttcccaaaggcagggactctggttctctgtgtcctgggatccccagcacccagcacaatgtcaagtgaagagcatactgtaaatgtttattgcattaatttacatgcaattgaaatctaagaatcattattatcaacagcatctttaaatgtataaattgatcatggtttatataaccaaagcaggaaagctccttgtctataaagctgagtacaggcgggattgagggatactcttttccatccttcatgccctacttcaaccagagacagggccagtggtgtggctaagatgtttatgtagccctggagcaagtcattttaaggggcagcatgggtcccaggagaaaagcccacaggacaagcagatccaagtccatgaccaaggtctctaccaggaccctacagaacttcaattactttcagtttggaagccctgggaggaaggagctgtgctgagagtagatagcacctgtactcactgctgtacgagttgtgttagtcagatttttcatgtattagtttcttcctccagaaatttttggtgtataaaaattacaaccataatttaagtgagtgtagttttagactgagtacatagaaaactgatccttcaagtattaataacagcctaaatgtcacttcttccaggaagccttccctgactacctattccccttcactattcatagcatgtcttggaacacttggtgggcttgtgactattaatttactatctgcaccccactgaacagttgtccccctatgggccatagtgagccctgagggctggaattgtctctgacaaaccttatgctatgtccctgtgcccctcatagtgcctgacatgtatacgagactcataataaccattagtcaaattgttgactctcaacatctgttttaggcaacggtgaaattatccccccaaaagttttcctttccttttcattaattttcaaagaaagcagcatataaccaatgtattaaagtacttcacattcgtaacagaaagaacttctgcaagtgaccattcactctatgcttgaacaatccgagaaacagaaactcactaacccagggagcacagctctgcctttggccagctgtgactgctacaagttcttacatttattgcaccaaaatagaccttcctggatccagtgtctctcctcccacctcttaaccctttggccaaatgacagtcctcccaggatttgacaacagatgactttccttggtttactcttttccaggaaacactgaacaccccaagtccttgttattgtatctcctgtcatcatctcctgcccccctaactctggtcatgcccagtggcagcaccagaggcgtcatctgagcgggcacaggcacagtgaagctgtcccttccttatctggaacattcttcttctcccataggtggcaattacacaggttgccttggttgccatattttctgattcccagggactactgcttctcccctacaaggacccaaggccacctttaacatcccttcgagcatattgtctggggacctccagcagattcgtctgcagtttgttgcctccctttattcccttccttggaaggcagcctgcccttcagagtctgttcctgtgggggccatctcctgtccgcaggttctcttgttgcctctcctgtccacggtttctctggtaaccccccccgtccacggtttctctggtagccccctcctgtccacggtttctctggtagccccctcctgtccacggtttctctggtggcccgttctgtccacggtttctctggtaaccccccccgtccacggtttctctggtaaccccctcctgtccacggtttctctggtggcccgttctgtccacggtttctctggtaaccccccccgtccacggtttctctggtagccccctcctgtccacggtttctctggtggcccgttctgtccacggtttctctggtaaccccccccgtccacggtttctctggtacccccctcctgtccacggtttctctggtacccccccccgtccacggtttctctggtagcccccccgtccacggtttctctggtaacccccccccgtccacggtttctctggtaacccccccctgtccacggtttctctggtaaccccctcctgtccacggtttctctggtggcccgttctgtccacggtttctctgctggcccctcctgtccacagtttctctggtacctccctcctgtccacggtttctctgttggcctctgctgtccacagtttctccggtgcctccgtcctgtccacagtttctcttgtccctccctcctgtccgtggtggctcacaggtctctgaccaggtttcagcaccatggcaagctctgtcacaccctgaaaggtaaccaggaaacacagactctgacacagaaggtgcacaccccaacccctctcctctcttggtcttcccacccctagttcaccctgaggactgttatccttgagaagaataagacagagaacaaggggctctcctgtgtccccacacctcctcctattcaccaacatgaagggcccgctccctctcccagctacctctccattgttaaacctttcatgtaattcacctccagaactttcagtcaccttcactcattctggtctttagcctctaacagcacttcttcataccaagtccactctcttatattagtccttgttgctcttgcatccactggatttggggtatctgacccccaaggcgagctccccagcaagcacccagcgcagtctcactggctcctgtcagctcttcactccttcctcacctcacagaggctgcagtgggactctgaactgccccatcctcctacaccaccagtctccctggagcaagccatggcatcccgcccactctttcgtgaatgcttctgacatcttcctaaaccaggctgcaactccgagcctatacagccctctcagtcttcctacaaacccacagatggtacagtcattcttggccaaagttttcttctcttacatttgaccaaacgatttctgtgcattgtcaagtcaataatttgccagaaggtcttcttctaggcatacgagattttcagcaggtgcccggaaatatcaaaatcctgtcttattaggtgttttcagagagtatgtggaggtcatgcattacagaaaaatgaccttgaacttggagataacacaggcgaggccaaatcccagcccttcttgttaccagctatgtaacagggcttgagtttcttgactttcactaaggaaataaaaaccttaccttgacaggatgttgtacaattttaatcaaatgaagcagtctgtccaaactatacatcggaatgaccaagatagggagcctttttaaaagcacaggtttctgggcaccattccccagagactctggtttggtaggtctgaaagcagaattatcaaaaagccccaaggtgtttccaatgtgcccacagatttggggccacagaagtcacgtttgaaaatgcccagcacattgacctgatgggaggaggaaactgaaaattgagatataaatataactaggaagaatgcaccattgacccaataaaaaagttcttaggcgtaaaacacaaacagaaatgtatgcatggacatccaagatctgaaaagtggcaagtgtgactggggagagtctgggaaggccacggacaggagggtgaggatgggctttgtaacgggtcccccagcccattggagggagttagtggtagttgctacagacagggtgcaaacgcagcatcagagaggatttataagtcacactgggagactgttgaacaaggtgacatcactgagataggggctgagctaaaggaacctatagggcatggatgtggaggtgcccagtgaccaccaagaggggactgtccccaccctacccaggtccaccatatgccttggattggtgtaagggactgcagtcatggacactcatatgcctctccaggctgcctgccaactcccagacaagagcctccagtgaagatggctgtatcttcattggccccgtcagtttcagaaacttcaatgttgcctgggcagaggcatcaaccaccacaactgcctacttcctccaggggctacttagcaaatgtctctgcatcttgtggcacctggcattcctcctcatcctcctaaacatctctgcagaaggtctggctttctctctgtgggacaagcctcataggtgtgtgccgtttcattgatataaaatttcctctcctcatttgtcttccattgaatcccattcttccccttgtcaatttttttccaactctttgtatttcatgtttttccacctctaatcttcttgaccccaaatatgctttttccttctaactgcaatattcattgtcagattctattaggcttcattctctgagaagttacagtatccaaaagcagtctttaagccacatattttttcttcaattccagaaaatctcttgcatttatgtttaactctggacagagaagtcccctaaactgccatactcacccttagtgtgacaaagtgattggccccattcccaagactcagaggtccatgtatttgtggtttatttgttcctctattaaacattcatgtactatttgtctactatgagccaggcactgtgctagcactagggataaaagactgggtatggccagcatggcctctgccctcctggagcttaaagtctagcagggaacacagattcagattatccatggaagacttacttgtgtggtgagcaccaccaaggcagaccctgaggagggtgggaatatgtaggcaccatctctgtctactgtcttgggccctccttttttcatccccagccaataccagctgtcgaccacacacctacagtcaacaactgcccaaactcttttgatataagaaccacgtattgacattctcatccttgcttgaagcctgaaaaccaccagatacaaaatgtcacagattcagtgataacatttcacacaaagtaggtgctgctgttataattagctgtggttgaaaaataattcctacaaccaaggatttggcactaaatgatttcaaaaaatagaactgaaaaaatatgtttggtaatcaggatttattctggaacttgagattggtttgtatgggattatcttgtttttaccacactctatttggggaggaaaggatctgatatggcttgaagttttgctggttttcaaatgccagggattttgggggggcccaggggtactatccaaaccatagttcattgtactgtcctatacaatgagtgcttacagtggccatcgtccattccactaacctgagcttccaccactggaatttgccttctgagatctcccccagtcggctgatctgtgcttcctccatcacccctccctgaactcagctggcttgttgccccatgtccctcgcagcgtgaataatgtgtgtgggatgtcacatcccctctgatggccaactctgccagaaagctgggaacattgcattcagaaatcactttgagtgtaatttttctttctttccgtctttttttttttttttttttttttttggtttttaattcctacttgtgaactttcaaaggcagaggaaaaaaactcacgtctctatctcttcttttttgaaaaacaaaacccaaaagactcctgggattctgctcagagaaccaaagatgtttcccctcagctgaactcggccaccatcattgatatccacccttcctccacctacagcatccgcatgtacgccaagaaccggattggcaagagcgagcccagcaacgagctcaccatcacggcggacgaggcaggtacgtgggaccgggcggaaccttgctccagaggagcccgggagctaactcttgagggctcagatgcttaaatgcagaagcagacctttgcccgtgctaggcggaggtctttgatgcgtgctctccgtagttctgtgccctataaaaaacgcagacagcgctctgcatcttactttgaaggcactgctcttcaaataggatttagttcaagtttcccatacccaagacttaaaagaaagacgtatgaggctaacaatctggtgagattcaaagaatcatgccgttttacaattcctttgtttggacacatggaatccaggttgacaggagaaccgtgagtgtgtttctttcctgagaccctgtgaagtccagtgtgggaggaagcagtaatgcttaactaggaatctgcaagcatgcttactgtgcgggagatgtgggaaggggaacagattattttattgactagaaacatcaatatttaaaaataatgtttttgctcttttttctattacaaacaacattatatttagtgttgcaaattcagaagatagagataagcattgtggagaaggcaaaacagcttccatcattttcccactgagagctaacccaggaacaggcagtgataactggctaaataatttcatcacccacacacgcacatgcacacaggcacgcaccagtgtattcacaccccttaacacactgcgagccactcatgtttccgggggggtgaaattaacaggtgtgcagagaactgagcaatcaggcaatggtccatgaatgctgattgtcagcccgcctcctggcaggaggagaggaagccactgcgcttgggtttcatccacaaggattgcatgcctggcccatttattgtagggaaagggtgtccagctcccaaacctacctcttcttttcctgcccaccatcagagcaatcagccactccctactgcagggaagatggcagcttagtctcaagtccctgtttctccatcaccaagattaaggtgattgccacacccagatggctaacagaagaccggaggtttgttgcaactttcaagagaggttgatcttggcttccttcccaccacctcatctctgctaccctcattaacagcatcccaaatataaatggagcttatgtatctcttaagtacttttctacaatttgtaatgatatctctcactatgtgtttaacaaatctcatattgccaaacgggtcaattattttcgagttttcattagtataaacaccactacaatgaacatcctggtggtatgtcttttgctatctccaagatcattttcttagattaaatcctaagaagtcagatggctggatcaatcaaatgcaacattttcacccttctgatatctgtaatcagtgttgtcttcaagagaataggttaaaatgtacaactcttcctgaactgcagaggaatgcccatttttcaatgctggaagatgtcagttcttgaaaattgttttcaagagtgagtgacagaagatctttaggctgaagtgcctgagagtgagccatttctgagacttggattctctgtatgatttctcatctgcaaaatggacattatgatgcctttctgctccttacacagacatatctgatcactgaaaaaaactcaagctctgaaaatactttgcatgtctcagaaataagtgggaaataagtgttaatctgcttctgcaaaaaatagaattgtatttaattatgtatgtaaacaacccactaacttcctcagatccctgagatttcattatgctgggtacttagggagaataagctgtccccatccttcagcccaaaatgtcatctctgacttcctgctcaatcttctccttctctctcaagcccttttctaatctcgccccatcccagccacctcctcgggaaaacagcatttttccggtggtgcattttgcacctgcttttctgattgccattattaatgctgctgttgttgcttttttcttcgtttcctctgtgacctctgctgcggctggcagttgccatggaagcagctctctccctgccagaaggccaggtgaagagcctctggggtgctggtctgcagggcagctgcctggcatgtctgcagacagatgcagatgctgcctctttggctcccaggctggccttttgtattgtatctgggtgtgctggctgtggcagccccacacagcccctctcctttaatattcagaggagctaaggggaagggaaggaaaggagcaggttctagaaatgaaaagctacagcagataacttgtctttgtcttggttcataggtttgcatgactgaaattaaaaagtcaatttcccatgtgtgacttacctagaatggggtgctctggccaaaggcatcctcattagagtattgagcaggggctgtagacactgctgccccttcccagcaggtaaacccaaaggcacatctttttaggagctgtagctgtcttgaggtgaccttgtcccactgttcccttattcctcatatgggagcctccggaagctgtcagcccactcacttttactgtaatctagtacccaagtcttgggcacacgaggatgccccccaatgctactactttgcaatgacacttagtgactccccagagcccaatgcccagcactcacctgcctttgcatgctcccagacccctattgttgtgcttcttcccctgtcttgaaggcactacaagttccatgtctccttttctgtgcccttccttgaaaagtcaagttcaagaatgccttcctccctggtgcaatgcctttttccatctcccatgtgtagttagggactactcagctcaggacagaggagggattttgctgacagtagcctttgaggtgtatcatcatgtcttcatggaccctgctgtccatgatgatataccacctgatgtggaggggctgtggccccctccacatcagggggcatatgtgcttacaattctgtcccttgtgtgtgtctggcataagggagatgaaagtatgagatgaacgtttataaacattacccacagtattgcctttagaatgggtgtcacaatgagcagagtatgtgtgtgtgcgtgtgtgtgtgtgtgcgtgtgtgtgtgtgtgtgtgtgtgtgtgtatgtgtgtgttgagaaaatatatgctggattaaacccacagtgaaattctgaagggtgccctggtctgaatgttcatgccttccctttcaaatgaatatcctgaaacctaattcctaatgcaataatattaagaagtggggcctttaggaagtgagggtggacccatcattaatagcatcagtatgcccttatacaataggcccaaggcccaataagatcacttaccccttctgccccgggaggacatgggaagaaggcactatctatgaaccagaagaatgagccctgaccagacaccaaatctggcatcttgatcttggaattgtcagcctctagaaataaatttctgtaagaaataaacttctgagccaggcacggtagttcacgcctataatcccaacactttgggaggctgaggcagggggatcacttgaggtcaggagttcgagaccagcctggccgacatggctaaactccgtctctactaaaaatacaaaaaaaaattagccatgcattgtggcacatgcctgtaatcccagctacttgggaggctgagacaggagaatcgcttgaaccctggaggcggaggttgcagtgagccaaggtcgtgccactgcactccagcctgggcaacagagtgagactccttgtcaaaaaaagaaacagaaataaataaacttctgtggtgtataagtcatgcagtttagagtactttgttatagcagccccaaaagactaagacaaggacttcatgcagaaaagtagagaaaggtgaaagataggacaggaaggctgagaggaaagaagatggggaaagaatacagcccccatcagagctccagtgaccacccatgaaatggctgcatctggagcttgaggtgccctccccgcatcctgatggaatagggcatgtcccaggccataagctgcagcccacgacagaccaggcctgtggatgtgagtcggctcagtgttgtgcgaaacttttaaattcgatgttaatttttaaaatctggaaatttcagctgaaaatctaaattttgagttcctcttgagttcctgcttggcagcaatgagctggagttaagcatggagtggccatcccagaggctgaccataccccctcagtgagccatagttcccatcctccattcattgaaggatcagcaaactacagtcggtgagccaaacttcacctacagaccttgaactaagcatagttttttcatctttaaaaaaaaaaaaaaagaataacatgggcccataaagcccaaaatttgtactatctgagtctttacagaaatgtttatggatctctgatgaagtctggccaccatgggaatttgagttttagatttctgctgtatctactgcaaagcttagtgaggaagggattgctgccactggcatagtgtccctacctaatgttgggaaatctcattgctccaaccccaaactactcagtttatttgcatgtgttgcatgtgaaagtgcataaagcgttatcataccactttaatacactcgacctcagagaatagccatgaagccaagaccacaccattcagcgcagtcttcatggcttccccaaccacccctagcaccagcagcccccacaacaaaggagcagtcaagagaataagtgacacagtcggagttaatgagatgagctgttaatggacccgaagtgtgtctctttgacacggatcagccacgtgacacatgacattcacagctaacccttgctacagaccaacttccccattagcagctgccccctgcaggtcatgagtcacttagtgccttgtgaccgagtttgggatggctgcccccttcattattttcactataaatctgtgcatagaacatgcagcttcaattagtgggtgctcattgaaacaccactgaatttgacagaccatcagagaatagaaggtgtggattatggaagggtcatgatgcagagtcactgggtttccaatgaatctggcactgagttaagtccttgcctcatctttcctcccattccggggcagcagctgtgatctggaagaagagtttcctatgtgctgagctggggtggaggggagaggatggaatgagggcagaaggaataaaagtcaggagcatgtgaagcaaacacagggctagcagtgctcattagtgcagagggcggcatcaatgtgttcttcagtaagagtcaaatgcacagcattcactcagcgagaagagccgagcacaccccatgaccaaccaggccctcagcgatctgcctctgtagatttttgtcattctcctccatcctgggtttgaagaaactttgggaattaaatctaaagaaagttatcggccttcttgctgtccctcatacacattgtgtatacccctgtctgctatcctgaaaggttctggaacagttctggaatgttctgaaatgttcttcgtctcttcccttaccactttcaaatattattctccaagaatccaatcctggccaccctattaaaattcaacccactgcccactccactgggtcccctgcctcccttaccactctccttctagcagtcgcttgtatcagcacccagtgtactgtataagttgttgatttattttgcttatggtctgctttgatcccatcccaccagggcaggtggagttgcttgttctgctcactcactgctgtatcccaggcacctagattggtgtttagcacataggatgtgctaattaaataagtaggttaaataaatcagccatttatttaataagtagttattacatgacttcagcctttccccatctgggcaccagctattctttgtcgtattttgatttttactaaatactgtcttggttccctttgtccaacacagagcatgcctctcgcccacccacccaactcctgtagaagacaaacgtgtgtttgtagaattatgcagctgctcctcactactttttaaaaatttatatatttttttctgcttttgtatcccagtctttgcctagtttaggacctggcacatagaaggcaaatctcccaatcagaaccagaggcaaaaatgtgggactggttctcactggggtgattgagcccatatcaattaatgatgaggccccaagatgctggctaaagccaagatattgagacagggaggagagtattttggagcagaatggagcaccgaggcttgagtctcagctctgggagggacacaggagctgctgggcagtgggaggttgtccagctggggagggacagaagcagagacagcgtagccaggaaggatcaggacagggaagcaaagcggagatccatgcgtttggcaatcaggaggtgcctgtcatccctgtgttttcagccaaacagaatgaattgtcctgacttttacctttgcaaacataatacaaattataaagatagtcttcgcttattactgctttacagatcgaagagttttggatttcttagaaatgcagagtttattttgtaaaatcacttgttttttgtgagatggagtcttgctctgttgcccagactggagtgcaatggcacaatctcagctcactacaacctccgcctcctgggttcaagcggttatcctgcctcagcctccccagtagctgggattatgggcatgtaccactgcacccagcaaatttgtgtatttttagtagagaccatgtttcaccatgttggcaaggctggtcttgagctcctgacctcaggtcatctgcccactttggcttccaaagtggggaagccaattctgctttttctatatattacatttgaaaccatgtaagtaaattcttaaatttccaatgtcaacacaattttcaaatttagttaaataaatggatatacctaatttttgacccttaatacattttgcattggaaactcaatcggctttggactgtaattttataggcatcattggcaatgagatgataacctatgaaaaaattacagctcaggagttatacagaaagcaataaaattcttaaagaagggaaattttttataatttaaaaaatttttaaagtaatgttttagaaacatagtagaaaatttagtgccctttgtaaaacacaagcaaacaaaaaaccttcctaatgatattggacatagccctattgtgtgtttgtacaaattaaattattttggtttgtctggactgttttcatcactttttttttttttttaggaggagggatccaaatgctttcacttcagggaacaggcagaacaataaatacattactgacaaatcatggcagcattggtaggctaagtaataaagctgttacattcttaaaaacagttaagtctgtcctggatacaagaactgtaccccctctcctcttcagtggggaccttcataaaataccagacctgggcctggcatggtggctcacacctgtaatcccagcactttgggaggctgaggcgggcggatcacttgaggccaggagttcgagaccagcctgggcaacatggcgaaaccccatctctactaaaaatgcaaaagtcagccaggcgtggtggcacacacctgtaatcccaactacttgggagattgaagcaggagaatagcttgaacctgggcggtagaggttgcagtgagtcgagatagtgccactgcattctagcctgggcgacagagtgagaccctgtctcaagaaaaataaaataaataccagaccagattggaaaagtaagttactcccaattcatgattacattatgatatgtatgctatctgatagaattggggacattcttgtaaacactatgctggcacctttggtttaattatgaatatatctcaactggaaaatcaaggttgcaactcttgtgtgccatcttcctgagaggaccacaccaaaggccatgccccagggagcccagaggattcaggatgagacagtgctcctgacattgcctccaattcctaacaaactggcttcttgtcaaattcagttaagtgtaactaaattaaagtaacccagcctcagtatagctgtcagactcaaaaatcatttttcaaggatttttatggaaaaccgtgtgcttttcaatgagcacagaattatctgtgtgtgagggaaatccattccatgagtttttattgaatttgaggtccaaagtttcctgcctaagagcttgaccccatgtgcaagaaattgggtgcagaggctcaacaataatcatcaccattagctggaagccattctctccctcggctcctgttctggactttaacttcagttctagcagagcctttgcatttttggaactaatagatctgagaggctgtagcactccagactgccagctgtccctggacctgctgaggagagggatgcatgctcagcatttcagcatctacaaattgctttacccattcaaagcaaggactcactctgggcttagttcctggtgccatgtagagtctgctgggtgaccagagacatgcaaagacagacacgcaaacatatatgcacactacagggacaggtccccaggcctaggcaggtgtcagctgcagcgggaggctcacaggcatgggcggcaaaccctgatggagggagaagaaagccccagggaaaaggctcggctctacccaggggtcccgtgtgttttggacatggctgggacacagggtgcatagggagtgcgcggaacgaaagcgtggagaggacggcgaggtgccttctgggagcagaaaattactagggtgggtgaacagtgtgaattgtgctctggggccatgtcccttttaaaagagtacaatagagaccagaattaatgtttaggaactaaatagaaactgtcaccaggcatagaagtggggtgggagtggggtatcagagtgagagatagggatccccataaggacgatggtggagaaagcataggacaggggccatttggatcagatgtcagggacagcatcagcaagtgtgtgaaggaggggtgcagggaacaaacagcccagagacctaacccccacctcctctctctccagctcttgtcttttaacacctttgttttaattataagtacatcttaactggaaaatcgaggccgcaatgtccccatttcctttcaaactcatatttctaaaccataacaaaccacatatgctggagaatcggcttcgtttcttggcattcttatagtatcattctctcccagtcccgccagccctgacctgcggaatcagcttcctgcttggtcctcagtgcgaggacggagctgtggagtcccattatcctcttggagtagcaatccctgcatcttagagcactgactcctggggaggggcaccttgatagagcgccttagtgccctaagacacagggtgcacccttttctatagaccatagccattttccaagactttgttttgttccaaagcccataactctctccttcatgttcccattctgatttcctgcttggcttattgtcatattgttgagaaaagcaacaatcaggtttcaacccgcttctttcaaccagtaagtttacctgtgtctgccctcacctggcttccctcaaccagtaagcctacctaaggcctcccgtcgctctgccctcctcccatcccagaggtatttgttcctttgccccactcactccatagcctgtatcttctgccctcttcagtttctgccaggacattcattattccttcaagtttaccttttgttgttgttgttaaatttctcccatttgcttccccctatttacaaacacttaatgataattatattatgattatgatttcttatatttactgagcacattgttttcataacaaccctatgatacaaattccattggcccattatatatagagagaaatggagtcacagacaagctaagtaacccgcagaaaaagcacacagccaacaagtgatagaaccagaatgtgaacttggacagaaaaaactcaaatggcccatcaacttagcaactacatcatgctactactcagaacttcctcttcctttataaaaaaggaagggagctttcccttagtcatgcgcttccccaaatctaccctttatctataagatagctttacttttcccattacttccaaactccccaaaatgagttcatatccactacttcagctttcttatctcccgtgtgccatacaaccttttgcaaatgtccacagaactggctttctgtagttctgcagtgatctaaaaattgtcaatccaaaaacattttttaatctaaaggattctttccctctgatctctgtgtcgtcatttgcttctgcttctcagaagacacctgttttcctgctgccttgcattgcaaccttctttcagtgtgtgtatctcatagctctgattacattctgaactcttggttggcaaaatgttttacatctcttagttctacaccatgtacctagtaggtagcacatttccaacacatgcctatcagctctaactgggatgtaattggaattgtctctcattggctccctgtaattgagattgtctctcattggccccctgtaattgggattgtctctcattggcccactgacttattgcacactcagcagaaataggttgctttaaattgcacacttttgtttcctctttaacattgcttcagcactctgtggctagagcccctggttcacaagggtttttttgttgttttttgtttgtttatgttttgagatggagtctcactctgtcgcccaggctggagtgcagtggcgcaatctcggcttactgcaacgtctgcctcctggattcaagcaattctacctcagcctcccgagtagctgggactacaggtgcatgccaccacacccagctaattttttgtattttagtagagatggggtttcatcgtgttagccaggatggtctcaatctcctgatctcgtgattgcccgcgtcggcctcccagagtgctgggattacaggcgtgagccaccgtgcccggccacaagggtttttaattgaagaacaaaagccatgaaagacacccaaaggcagaagaatcttgattatttttgcccgaagtcattctaatcaattgagaaaccccaataccacatcactaagcaaagcttccagcggggagagaaggaccttcaatacacaccatagacagcatttcataagggaaattttgttttgcaactttctgttgtaccccttgttcaaaattgggattgattcacgaggttgtcaaagacatggtgagaaggaataccatgataggtccccaagattcatgtttccaaagagcaaataaacaaaggcctagagttggacacagtaattctacaaaattgacatttcccatgaccgctaaaaacttctttctctgtgccaaacatagggatgggttgtcctcggggaccacctttggctgtgtaggcttcgatctgctccggaaagcgtctctaacctgcctgtgggtttttggtccttacagctcctgatggtccacctcaggaagttcacctggagcctatatcatctcagagcatcagggtcacatggaaggtaaactcagcaaacatttgtattctcggtgctttccccccagggcgagcccttcactcctgttcagtgttatgacaccaagactctcgaattttacaaaacttttattttttcaaaattaagttgaaagcccttttcttaaaatgcagtatttgtatccacattttgaatacttttacagcaaattctgtgtctcagagaataaagtggttgtatcttttttttttttcttccttgaatcttgatcaaggtctaagcagtggtctctacagaaatagtaaaattgatgtccctgactgcatgctctcatttcatcccagcaaaaatgttttcaaattgctttttttaaatggcaaagcatgcggtggcagacagtccaccgaggtggcagaaaacaggccaagtcctcactgtgccactaactagatgtgttctcaagaaagcccctaaattttcttgccagtgaagtgagctgttgaatccactgactcccagggcagtgctaccccatgtgtggcccatagaggcagactggctgctggttactttagtgtttgttggaagtagctgggagagaaagaaagcttgagccacagtgtaaacaattgcatcactaagcacatcgtttcattcaacagccatggtttccatagcaaattttctcaagtaaggaagcagtgttgattctggagcaagctcatcaccaaccaccactgttccatggccttcaggtcagtagcatggccctgacctggtgggccatggcattagtcatcctcctgaatgtgctcttggagatggctctgtcttaggccaaattccgtttcatccagaacgttattatcgaatcaaaagttctgtaacattgcattaactatccccgctctgaatttctctcatggcatgtgattttttttcttgtctctttcctcaccgttttttttctgtggcgtcactgggagaagagggcagccaacaactacaataaggtcttcacatcacacacctcttctaaccattgcatctgtttgtttgtttgattgtttgtttgttttccttctagtatgggttctttcataagatgaccagcctctgtaacaaaaatggattttcattgttggggcggataccacctttggtattacgggcgttaatgcagcgagcccctttgtgtcagcgtttctcaaccgcagccaatgagttgtgtttccagcgggcagcgtgatatgactgtttagctgcatagaaagtgcaggccgaggagtgtgggaggtggtgtcattggtctttgtaagcacatccaccccctgcgagcatcacacacattgtagaataaagacgctcagcaagccataaccccacacgcattcccgccactctacaaatggaatgctgactcactctgtcttgaattgaagactgtgaagttttacccactagctttacacattctctcgtgttttgccctgaaaaagaccaggtattactgtggcctcaaaagctttttggatcttttgggtcctgcatgagagaggtgtctgtccacagaggatctagctcttataactaaaaatggaaacttctgaggctttaaaaggcattgtatcctttctctctctgtagaaagcagccacaaaagtcagtgcattgcagttaaatttctctttagtgccaaagggtgaaatgttgtgggactattaaaaggaagcctggctctcattagattgtgaatcgactgaatacattgttcatggaggagtgcaatctatctctgtagtgggcctttgtggcatggcctgtcagcaggcagacttgccggtgatctaactgactaatgaggttggggctgccctgtcaccagcttagcatttcacatcggcctgtttatataatgagcttttaaaggacaccactgattcaatcgaattggacactattacacgaaatcttaagtatatgtaaaggacaatatgttacatataacatgcctttatttatggcataaaattcagaatatctgttttgtgtaaggagaaagaaagaaggagaaatagcgttagccccaaagagggagccccacatctgtcagccacggtggacatatgcagtcgtgggaagtctaaggtggaagctcattcatggtcacggacactgatcagaagtaaaagatgcattcagtacagagacacagggtaaaggaggaaatagctctggggttttggtgggaaaatagccatttagactctaagcctttgaaaggtaaggggcactttggtggcctttctgtaacactggagatagatattacatttatttaattatcattgaataagcactgcttctgtaatgacaccctctattgatcaaaataagcaactttccacttttatttcattttattttatttatttattttgagacagagtctcactctgtcgcccaggctggagtgcaatgacacgatctttgctcagtgcaacctgtgtctcccgagttcaagcaattctcctgcctcagcctcccaagtagctgggattacaggcatgtgccaccacacccagctactttttttgtatttttaatagagacaggggttttcaccatgttggccaggctggtcttgaactcctgacttcacgtgatccacccaccttggcctcccaaactgctgggattacaggcgtgagctaccacacctggcaccctttttatcttagttatttctttcaccaaagaagagcttctaattttaaaatctttcatgtccagcaaaggttgctcaggacctagtgaatgcagccatcctacatcagctgcagcacctggattcaggccccttatcttgcctcgccttcccagggatacctacccaagcagcagtccacaagtgtcatcgtctctcctgtcagtgttcaggcagtttgtaacatgcttacctctcctgtccattcctgctcatttgaggctcagattgtgcatgactgcccccatgaagatgggaatccccagagtgcaattagagtttcaccctctatgttacccattgctcttggcgatggctcagggaggttcccacccagtggcttctgcagtctgtttcatgtgcatcccctccactgttctgggagctccttggcagcaggaagagaggcttactcagttctgatccctcatggctggcatgtgttccatgaatgaatgaatgggtaagtgaaggagaggtgagtgtatatgtgagctgggaatgaagaggcctagaagacaagtgttccatatcacaattgcctgtgaagcattacgtgtttccaagactgccatggagatggcatccccgctatcaggatctccagagagcaaacatgctgagctcaggtctaactcatgatacagtgaaatgccctagactatacaacggcaggcacccaaagatgtgaaccacactcagtacaccaggcgaccaaccacttttcatatgagtttctactatggtaattttcaatatagtttattgaaaagtaaagggcagtagtggtccaatttgtgataagtttcatgggaaatggacatcttcacatcccaaatataagcccatagaaagatattcaagaggaatatctttctataggctatattatgatgtctatattatgcaagatgaagtctcagaaagggctcttaaatacttttacaaatattaagctaattaaagtgctaccccatgccttgacagaaatccaaaagacaatgtaagcagttctgaataaaattaaaagtaaatgacaataaagtttcatttgacattcttggagaaacaaaaggatttgtgtaagcaaatacaatttaattcatggcaggttttgtttctgattcaaaatcagaaagaatatttaaagctatggataattgataacatatttgatgaagtacctgaacattgtacaactaaggaattctttggtttttcagaaaattccaatttttagtttatctcctaaagtgtctcttttagcagtgcctgtcaccttctctcctaatcagtctcagaatcagctgaccctctttggatgcaaattaaggacaatgtgattaccagctacttgtgtgcatgcttgtgtgtgtgtgtgtgtgtgtgtgtgtgtgtgtgtgtttgccatggtcactcataaaataaaacattcattatttagaatatttaatgattatatacatctcaaaacatttatccagagaatgcaatttaagacagagtttttttcctattgatataaaatttgtgttgttgttttatttttgcattaaataagaaatctttgcagaaccacaggctgtccccaaaatatgaaatggtcaattgcttaaatatttctgtgctgagaacaattatcaaagtgattacttgcaataaaaatcctgagaataattttaccatttggccctcagtattgtactatctgcgtgaaaattttactgagaataagcaaaattctcatttagaattaagaaagagaggtatgatttctgtaaaatactaagttgaatattcagagatttaattaaatttcagtaatctgaagaatatttttaaccagaatatcacatctccactatacccaataattccagctaattgaggcatcattacaacctattaagtttcagagttgagctcttacaacaggaaaatgactcagtctgtcatttaaaaacaaaactgccttatttccagtgacctccgtagtcatcgtttaataaactgcaggctccacttgccttctgcactaaaatccctctaccccagggaagtgcaaggtaccttggaaaaggcagtcttggaggcaccttccagcactagtatttcctggccaactgggacagctgtccttagagatatttgctccccgccaggcacaatgctaaacttctgcatgcattatctcatttgatctgtgagctgggaacacccagttttgtgcagagggagatcctgaagtcaaaggaacttacccaagttctgaaggctggtgactgtcagattgaggacttccacccaggctgcctggttctgcctcctgggtttctgagcagtcaaccagttaattactaggaagtgccaagattgtagttcgtgcataataatgctcaataaatattaactccctttactattccttgcaaactcatgttataaattatacccaaccccataaaaattaaagatatatgaaatttacattcttacgtagtatccttttctttccaaattgtaaacttaagcttagagtaactttcatagtgagtagacacccttttttcctatatcaactgaaattcaaaaaggttgccttgaaataaactttacttaattcttcaactatcactttaatctttaggctatgaaaaatgacaaaagtttgcatttgcttttaggaactaatccattggttctagcattggttttataatagccttattgaaattcctgaacaccaacatgtcttacaaatacttaaagaatttttagcccttctcatattaacgagtctaacctccttccttgataacaagaaaagaaaaaaaaatttcaaaatctctggtcatccgtataaagtaagattgttctttctcaacttttttaggtggactagactctaggttccgtgagggttgaggacatgtcttgtgtgttcactgtaccctcagcaggagtgcaattaatatgcgttaaattaatgcataaaccatttaccattgtttacttttatcataaaaggttcatatcaagaggtggtgcttttaaaaaaaaaactgtggactttctagaaagccctaggtgactaaatttgcatctttttggtgtatatgtaaactatgcatgtttctttaatgaagccatggtgtttatttataccatttggaatgtattctgcatctctccgtctatacattgggttactcctctcggtttagccatgtgatgggccttcttcaaggactccagttctctgtcccaggacagagctgccagcctgcatgcacaaagggtccggcaggtctcctcaactaagcaggcagttcccttggtttccagcctagagcgcagccaggaaaatgctggctgcatttgcaagagctactcgcagccacaggggtggaatctaggtctgatgctcaggcaggctgggaagagacactatctgggactgtcagcctaagaggcaattcttgattcaaaccccactgaaaaagctgtacctctccagcagagtggccttgacaggacacaaattgaacttggactaaggcttaggaccaaggccgtctgccgtcgagccagaaatcctgttggatggtttcttctaagagtttcacgttgagtctggatgaacacaaaaaatctaagtgtaggcactttgattttttgtataacggttaggttataagctgtaaagttgcaatataactttagaaggcaagtattgtatttgcctgatttaaagagcatattatcagaaatgcaaataaggttgcaactaaaggggtattttggacatctattgacgctcatccttaggtgttttcttagtgcatcaacattacatttttacaattggaccaggtcctgaagttgtgacactaggtcaaaaattgtgtatggtcagaatgatattgaaaatgacttaaattgtctaataagcacactatgcataatattcactaggaagctttacagtaacatatatatacaaacatgtaatattcatagtgaaaactgaaaagtacatgtaaaaatataagttgacactatttcatcacattttaaagtaacattagcgtaagttaaatccatttccaacaagtaaattatatataattagaatacagtgtaaaaagtactggattaaatttcagaaaattagatacgacacccatctctacacctaacaaaatgaccttaagtcacttgatttgtcattattggaacttgaacccttttctctagttctgagttgtgtgttttattcattatgtcataaccaagaaagtagcagtgcattttaatgatgaattctcctctctcctcacctcccagtgctgacttgatagccatagaggataacggatgtgggcccactctggaatccataaggtggtcccttgattaacaaccccgatttggatccctatcctagatgctgattccgcccaccccaccaatggctctggacagcactgccatttctgatggcaaatatctcccaataaatgtaaatgtggtgaaattttcccaacaaaaaatagaagtttattttcagtaacctaataatagatggatagggtcgggcacagtggcacatgcctgtaatcccagcattttgggaagccaaggcgggcagatcacttaacatcacgagttcgagaccagcctggccaacatggtgaaaccctatctctattaaaaatacaaaaattagccaggcatgatggatcatgcctatagtcgcagctactcatgaggttgaggcagaataattccttgaacgctaggagacagaggctgcagtgagccaagattgctcaactgtactctagcctgagtggcagagcaagactcgtctcaaaaatttaattaattaatttttaaaaatagatgggtaggtagtaatttaataaaagtattcagaagaccatcttagacagttttatcagttctcatataatcctaactctgcttttcacagagaacaaattggaaaatcaagctaaagttaatatggcattgagcattatgaatgcatggatgccatccgtacagggagtgcataggtggatatacactgtttaatgtgctgtatttcctcagacagcagtccttaagccatctcgctgatgacatttcccatcttttcagagaaatcaagtgagatacataagttagtaaacagggcacagatgttagaatgaaaaaggaaaacatatatccaatcaagaattacatagacatcatcaaatggcatctgctatgtcatggacccctctcctaaggcaagggaagaaacatgacattagttttattgttattattatggcaactcggctggacgaagttggttagggtccatcacaggaagaaccccagccaggagggcacagctattttccagactattttcaaggtagcatgaagcaagacagaaaaacacaatgtgtgccttcaaacgtatttcactagttcaaatacatttaagttaatgcactaagatgtaacaaactatttcaagatagcccataacatttttaaagccaaactcttcattgtattaaaaatgctgaaagctacttcaaattctttcaattcctgtaataaactcttcctgttcttttgaaaaatttaagttgagaccaaaaataaaagtactttgtgctttgagtaattatagatgtataagaaataaaaccattttaccttcttgttttgcctgccagtaacaatttgaagttggaaacagggtttgtttttctgtaaataacagaagaatttaggtggcagatccttagtgaatttaggaaacaagacttcccactgaaggagagtgtgattcagggagtgcctgtgttgctcccgtgggcccgtgtggaatctgtggcacgtgttgcatctggacttgtggagtatttcccctcaacataagccagagtgttcacaggggcccttggtctgaatgcttctagcacattcctaacagggaacatacagtagcctattggacaactgtttcttttctttttttcttttcttttgtttttttgtttttgtttttgttttgagacagggtctcactctaccacccaggctgaatgcagtgtagtggcaccatcctggctcactgcagccttgaccttccaggctcatgtgatcctcctacctcagcctcctgagtagctgggactacaagtgcataccaccatcaccatgcccagttaactttttgatttttgtagagacaaggtctcactatgttgcccaggctggtctcaaattcctgacctgcagcggtcctcctgcctcggcctcctaatgtgctgtgattacaggcatgagccactgtgccttgcccagacaactttttcaatattctcctcgcaaatacctattcatgcatgttgatgtctaaaattctctttagtcaaggctaaagcttttcattacccaaaaatagataagaggctaggcatggtggctcacacctataatcctagcactttcaaaggctgaattgggaggattgcttgagcccacgggtttaagaccagcctgggcaacatagtgagacctcatctctatcaaaagaaaaaaaatagctgggtgtggtggtgtgtgcctgtggtcccagctgctcaggaggctgaagtgggagaatcacttgagcctgggaggtcgaggctgcagtcagctgagatggcatcaatgcactccagcctgggtgacaaggcgagactgtctcaggaaaaaaaaaaaaaagaaaaaagaaaaggaaagagagacaaagcctagctctagagaaagaatgccatcctcctcttaatccctactgagctatagagggcagatattgaatccaggactggagctccattgttactgcagacattactattccttgtcttctgatagaacacaagttagaactatccattggagcatggataaaaggagagtaacgaactctaaccaacactgggcagagcccaggcctttctccaatgctcctttcttagtagtgcctctcctgtcaacctttctcccctctctccttcccaccctgccttggacctgcagcacacccagtaagttctacctcacatgctggttctgtccacagcactgtcctgtacgagtctgcaaactgtttctctaatgggccagagagcagatattttcagctttgtaggccctgcagtctcggtcttaactgctcaattctgctgcataggcacagctgcagtccatgcgtggatgagtgaagacagctgggatccagtaaaacttcacctaggaaaggtgaaatttgaagttcacataattttcacatgacaaaatattcttcctcttttgatttttttcaatcatttaaaaatgtaagccacaacaagaaaccgttgttagctaagagccacataaaaacaagcagccaaacagatctggaggagggaccagtttgtcaacccttatttcctggattgagatgatctctcgagagggagccacatccaactgagagagtctcatctgagacaaggctagcccctcccgccatatatgatatatgctaaatcatcactctccagttcaaagatccacagatctttggggcaggggcacaatccctccaacctctttgctaatgcataacagaagtgacctttgctccagttcccaataagttcctcatctcgtcttagaactcctcagcctggacttctttgcctatatcactaccaccattgtgatcataacaatttaacaagtctctgggaagttccagactttccctcatcttcctgtcttcttctgagccctcaacactcttccaacctcagctcattacccagttccaaagttgcttccatattttcaggtagctttatagcagtgccccactcaaaaatggcttctggttcattggttcttttggcacagatgtaaagcactcaggaattccttccagttataaaattaaagctcacctttcagtgggcaggctccttctgagacctggatcttctctggttcttctgaacagatacttagcaaaaatgacaaaggctgcaacaacccggcgtgtgactgatgccgcttactcctttacaagcccctttctctctctctctctctctctctctctctctctctctctctctctctctctctgtcttagtttgactgtcacagcttccacctgcctcctggcagtgccgttcccatctgtgtgtcccttccagcccagggtcactctcacccgctactggctctcagcctcatccctgtggattccaggactcagtttgtctccatacttaccctctcctcctacatcacttaagggttctcttagttattctttaatttatattattaaatataatataaattatattatatatagggtgggagggaaatggaggcagttccagtttaaggacctacagggtagacagaggctgccctgtgtgcatgtcagagcactggctggggcgactcctggcttggctccctgccttggcctccagcttcccacgccctgccctccccagtggaaagggcctgtttcgttccaaggaagattcttcttcaccctcctttcctgccttttctcatcaagacatccaggatgcctccagagcatgcagacccagtggtttgttggggtgagaggtggatgtggatgtgccttcatctcactcagctccacccctgcccgactgacctctttaccagcggtgttggatcatgattggccctcccctggcgctgtcttacagagcttccagaatcagacactgtcttctcccatcccgcaaaactacttccgagcatttttcatggccccatgaccatgcctttgaaatcctgcctcttgtgcttgtttatcagattggagtcggggtgcccctccctcccttatctctgtggcctttctcgggcccctgccctgccctccttggccacactgccgttacagggcctccattacctgcagaggggctactctgggttgggccctccaggcgtgtgtggtgggccaaagccctttgggttcactcagccaccgctaaatagttggggcccagcctcaggctcacagactagcataccccctcttttgcatcagagtgcaccctctaggtccccattgttgggcgcgggagctaggtgggggtattcccagaggccagccctcagagttgattcataggaagcaaagcccgaatgcccttgtgtggtccttggcagagagcactgataggcctctgtggctggtaggaaatgttaactgtggttagcaggtggtgtgatgtatgaggaacaacagaattcaaaaagggagtgtcccaaaaagaggagctatgtcacaggtgtttgttggctggatgaataaagcggaagctgtcctacactttagaaatggaataaatggagttttgctttgcagtagttaacctcaattccatgtcataaaattatcaatctatttctagcattctgcatttgtgtctcaaggcaaagcccacatataccttggccactctttcctcctcagctgccaagtctgactagaatatggcagctgcagcctgcaagtaacattcttggctctcaagacagtgcctatttcaaataatctgtcatttatcatttatttctcaaactgaaattgcacagcccctttgttctaagcactgtctcattatcaggtcatgtggcccttttctatttcatgaaatgtggacatctcatcctttcctagctcctcaaaagataatgactttgggggagccagtcacgtggccatacatctacccattatgagacctaggacacagatactgtatttaatacagtgcaactctaaggagagatatatgaacaaaaatatcatttgagaccggaagcagtggttcactgctggtaatcccagcactttgggaggctgagttgggcagattatttaagctcaggagttggagaccagcctgggcaacatggcaaaaacccatctctacaaaaaaagttcaaaaatttgccgggtatggtgacatgtctgtgatcccaggtactcaggaggctgaagtggaaggattatttgagcctggggtggttgaggctgcagtgagccatgatcccaccactgcactccagcatgggtgacagagtgagaccctgtgaaaaagaaagaaaaataaaagaaaaagagggaaggaaggaaaggaagggaggaaggaaggaaaggaagggaggaaggaaggaaggaaggaagaagaaaggagaggaaagaaaggagagaggagaggaaaggaattatttgaggcaataatgtaagaggtctcctcgacctgacatagccccctcaaaatccattgtccatggaccaagatagccagctggttctcacaccacccctatacctattgtaaagcagaatccctttagtgctgagtaaggtagatctttaaattactcccaagaccaggaaggtctaacagttttatgtgcatttattcccttttgtttggccaagaaccaggaaaatgggctactggctaacctgagaaatgggggaatgcatagttgctgctttttaactaaatagtctctcccagcaaagccaaatctaaatcactgagtgactcccagtgataacaacagtgattctcagactcagggagcactggtatcccctggagggctttttaaaacacacctcaccaggctccacccccagagtttattcctgattcaggaactctgagtgggtccccagttcttgcagctctaacagttttccaggtgatgtggatgttgctggtagcgcaccataccactacatacaggctccataggttctgtcccgtagatatgtccctagcttcatctgtgcttgtaccgtcccccacccctgtgatcaccatggatacctcaccccagagtcacttgagcctctctccattcctgggtgtcttctgtccttgcacctgggtgcagctgtgtatgccaattgctttggcgacagcattgtaccctccaaggcaatgtccagtcaccctttagctcaggtgaagtatgctcttctctggcaatccttctgaccacgatttgcccctccatagtactctgggcaaaccttcagcactgcaagtatcaggcagtattctgagcactgattcactcaaaggtgtccctggttgtgccatgccttgtgtagaacagatgcccagttaaggtttgttcaatgtgatgcacccattcactgagcaagcttatggaatggctactgtttatgttggaaagcaggtaaggggaggctgcagaaaacgcacaaagatgaaaaagactgtccacccaacttgtcacataagggaaatgaggatagattacattttaagtggatttggaggaatctataaagaaaatgttcaattcatttcccaactaaattattcagcatgcctgagaaaggcagcattcttcaaacgtgaaattctgcagtgaggctcttagcagactccagccaacaggtgaattctgcacatccagcagaggccatttcctttcaatgggaagggggcaggaggcatgagggaaacagaacatggctggtggtcttcagcacaagagatgcctgttctaatcattcacatccaggcaggtgcagtgagcatttgcacgtctactgttttactgtccctttaaaggatgatgcatctgccacaggcggcttgcagccgactgattgagaaggacatataaaataagtcacttgcacaccgtgcaaatacattgacatggtgcgactgttgtcatggagatcaaaagagaaggtttcttaaaggaagtggaggttgggagggatttggaagctggagaaagggcatctgggaggatgaaaggaggctgttgaggaggactacaggagaaaaaaacctgccaggctaggaagggggagagagcattccacagatggcagataaatgaaagaaatgagaagaaatcaggatcattactgaatccaaaggcaaatgaatgggggagtaaagttcaacatgggaaaaacaatctttgtgtgagaaacctaacaaggagcaggcatgaccttctcttagatttgcactgcgttcaaggggatttgagaagaggcaaacagaaagcactcacttaggaaagaagtcggttgtttgtaaatacgtcctcaaggatttctttaacttaaacacatttctaaatttcaacattttccctgtggaaagggccttgttttattgagttcttaaataggagtagaagggagcccttagttttttgttttttttgtgtttttttttttccatatgcttacgtttcaaaggactcctttaatttgtcttaagatgactggttaccaggtgagatttgctgtaaatctgcaggtccatcatcataaaaacatgtaacccaccggctggctgagtaagtgagcaaattctctttctggaatccttcttttaagaaggaaaaaaatgaatgacagtgtccaaataaattggctcatcagaagctattttcatccctggtggggcctgggcaatgaagctcaacccctccaaatcctgcctcaacctgtcatccttctgtgtaggccagcaggctaagtcccagtgcggaagccaactctcagcttgaatccacacttcccggctgtcacactagactgctgagttctccacttctgtagtggctaagccaggcctctcttcaacagctaaaccatgtgtctgcagtcaaggaatttcttctgacttcatacccttgctatcagtcctttacccagttagattataaacctgtacctgtgatcattcttacccacctcttttttttgcatctcatgtgtgttcaaaaccattctcttctccatctgcaagaatatcttctgagaacatccacagtgttgaagccccgatttagacagggggaaataacaagtgagatttcattctgtagggttctttgcattctagagcttgcaatgacattctttgaaaccacgtttcattgagaatggtggccactagaggaggtagaagtgatcagtgaatgccagtggagaccagggagggagaaggcttcttggtgggagtggtctagggaagagccctggtgagctggaagctgagctggcctgcagagaaggagtagtgggggtattctttgaaagaagaaggaagaacattttttgacaacagcttttataaggtgggaatatgtaagacagttgggatccccaccctttttcaggcagtcagagaggaacgcaggtgagcaagcaacacccaggaggcattagtcttgagagatgaggcagcgatcagatctcacaacaggtactactgagatcgggagacagagatcaaagaggcatggtcaaagtggtttcctaggaaatttgtcttctccaatattatgcaactcagattcaaaatatgtttccagatccctacctgatttcttgttttccttttcttcttaccccaccattaacctcattcactgagtttcatgaaagtgaaccattatttccacccatgtatcaattgttctacagtgctaattaacaaccttaatacagtgttctaaagatcatttccctataaggatatattctctataccccagaaaaccatctccctttgttcctagtagacacatgctccaagcaaagatgtctaaagcatcattcaaaacaattttccagttaaggatcttatgcactaatttgccttgggaatatgaagcccactgccagacaaatggattcacgtgtctccactaagcacaccttccactcctactgactcatccataactcagagtgagcctctagtgtcattttcgaaaacctgaaccacaggccataacatttcttacacttaatatacaaaatccctacatttatggatttttttcagaggttgttttaaaatacatccacaaggatttctttaatttaaatgcatttctaaatttcaatctgactagtctatctacaaattaataaagtaacttaaactttccctgataaagaatttttgcttgcttttatgcataaaaatatacaattttctcttcatgtgatctattaaattttcctctgattagaaatgccatgtatactattactttacaaaactaacaaactttgcaaaagggtgaaaagttctctgaggctctatgagcggttaataccaaatacaactttggagaattcctaccctgtacttgccttgagatagttgttttaacatatttgaccttttgtttcttcatgtgtaaagaagcatacttatactgtgtggggttttttagggaaagaaaatgaaataatatacataaagcaccaattacaatgggaaaaaacagtgttcaataagtggaagtggaggtggtagaggtagtagtagttgtggtcattgtggtggcattcatgttggtgtgggatagtaatggaatgatggatggttgtggtgatagtgatattggtgttgggatagtgatggaataatggatggttgtcgttatagtgatgttggcactgggattgtgatggagtgatggatgttgtggtgacagtggtgttggtgttgggattgtgatggagtgatggatggtggtggtgacagtggtgttggtgttgggatagtgatggagcgatggatgttgtgacagtggtgttggtgttgggatagtgaagaagtaatggatggtggtggtgatagtgatggtggtgttgggatagtgatggagcgatggatggtggtggtgatagtgacggtggtgttgggatagtgatggagcgatggatggtggtggtgacagtggtgttggtgttgggatagtgatggagtgatggatgttgtggtgacagtggtgttggtgttgggatagtgatggagtgatggatgttgtggtgacagtgctgttggtgttgggatagtgatggagtattggatgttgtggtgacagtggtattggtgttgggatagtgatggagtgatggatgttgtggtgacagtggtgttggtgttgggatagtgaagaagtaatggatggtggtggtgatagtgatggtggtattgggatagtgatgaagtgacggatggtggtggtgatagtgatattggtgttgggatagtgatggagtgatggatggttgtggtgatagtgatattggtgttgggatagtgatggaatgatggatggttgtggtgatggcaatgttggtgttggaatagtgatggagtgatggatatttgcggtggtagtgatgttaatattggaatagtaatggagtgatggatggttgtggtgatagttgtgttggtgttgggatagtgattgagtgatggatggtggtggtgatagtgttgttggttttgggatagtgataaagtgaagcatctttttagtgacagtgatggtggtaacatcaaggatgatgatggaagtagtggaggttaaagtgtggtttgttggtgaagtttgtgataaatatggtggtaaagttggaagaagtgatagaggtgcttctaccattaggttaattttatggcagtgatgttgatactggtggttgtaatgttggtgatgtcagtggtagagatgctattgctggtggtggtggtgttcacagtatttttgacagagatgaagctggtggtgatgatggtggtaaagatggtagtagtgatggtggtggcttggctgtgtgggggacctgagggagtggcattgatgttggcagtggtgacagtgacctgcagaggtggtaagcattgattggtggtggtggtcatcatggtggaggtgccagttagtgttgtaattgaaatagaaagataacctagagatgagttagcacactacctttgtaaaaaacagctttattgagatacagttagcatgccatagcattccctattttaagtgtatgattcagtggtatttcatatgtttacagagatgtgcagccgtagccataattgtaaacatttgcatcaccccacagagaaagcttgcaaccactggctgctgctcccatcctctcccactaccttttaagtctgtttttaaaccttatagtttggggacctgcaagctatgaaactgaaagtatatgttccctttataagaaacacatctcacttcttcctcaggtgcaacaatttattctgcatgaaaactatagatcatattagcaccctgaaaaaaaaagatgtaaaaacactactaccatcaaataacgcataactctactccatatatttcatttcaaaattggaatattaagaaaaatagaggagagctctcttgtttgttccttgtgatataatcccttaacttaccctatgatattgcacatctggaagaataataatcaaaaaagccctatctcattaacagccaattgaaacatggacttaaaaaataagatggtcatctacttctgggacttgagttcaataaataaacttagaaacagagaaactatattgtgaaggtgtctaacatagcatttgtggtagtaaataaacctggaaacaataatatccccaacaattaaaaaaaggttaaataaaataaaacatcaatatgatggaatatgatatttaaagactatgaagtaaagatgggaatataatcataatagcatattaaatgaagaagaaaaactcagacactaaattgtacaggctacaaacacagctatgtggggcaaaacactttactttagataaatagactgaaatgcatcaaaatgtgaatagaattgcattggatagaaatggtggttgtttacttttattataaaacaaaatgagataattattccacacaatattttgcagaagtatcaactaagaaaaaataagctttattttagaaccacaggactgaaatgtagttcttctaagaaaaatgtaaagaattttctttttctttttaacaaaatattgaaatggaacagaacaaaaacacctgcgttgtctattatagttaagctagttaggatgggttttcacccatggagaggaaacaagggaagatttctcctttctacctgtacaaacagatcacaggcaggattaatccccccaaactggaggaactacatgtcagcaagcaggtcccttcattcttgtggaggatttagctaaattggtggctctatgaaaacactttctcacaggcatttgactttactgtctactcttcttgacctgactccacagcccccatactgtgaatccaacttgctgtcttagggaggcttaaagcctcaccgggagccagttgaacaattagaatatttaatggatgtaaatctcatttaaaaaataatattattttatttgggtcactatatctaacattaaaacactaggtaaaataggggaaatctctttgttggtaaatttgacttataggtgacgtttacagggaaattcatttgattaattaattaggtcacataaatgtaattcagtggttgcagcaaaacaattttcacatagagtaattgaattttcaaaacatagaatcttgaaatctatttctaaacagtgagaaaagccatagctcatcaatgcaaaagccagcacatctgtggattcagaggagcatagacatttgtttataataaaaaaggtatgagctcttccaccagggtctaactccgagccaacagatacaaataaataaatggtttacgcgactgtttcactgacacctgctggcaccatgaatatactaaattagattggctgttgggaaaagcaagtggagtccaagaaaaccataaatggagaaacttgctgtgaaaaacaaaaatgattttactgctcttggataagtcagacttactactaatgacaggctgaggcatggaatcccctgggaagttattattaggcaatccataagtgtttgctgaatccatcaatgctgttcatcagctcgaaaccttcttctgacttctcattgtctgccctcccccggtcacatttggcaggttttcaaggtcttgctccactctgtccgttccctcctgacttaccgctgggcaggtgtgcaccctttgcaggctccactcaccccatcctccttctacttctctgagccgtgccccgccacctccccccctccgtcaagcccacctgggctctgagtcttcccaccacttcagaccacccatactcacactttctagatgcctgctggccttcactttcttaccatgcatttccacacttcatagttctctacaggttcttaagtgcttatttcctctctgcaggtcgattataaacactttcaggacggagaaagctttcagaggcttgagagatccagatccatagtttgtacttaaatgtatgtgtgtacgtgtatatgtatatacatacatatgtacatgtatacatacatacacatgtatgtgtgtatgtatacatacacgcatacacataaacacacatatctgttgactgcctgaaagtctacaaaacctttattccctagagcctcatcttggtggcattcgcatatctttttttactttttgagactgagtcttgttctgtcacccaggctggagtgcagtggggcaatctcagctcactgcaacctccgcctcccgggttcaagtgattctcccattttagcctcccaggtagctgggactacagacacccaccaccatgcctggctaatttttgtatttttagcagagacggggtttcaccatgttggccaggctgttcttgaactcctgacctcaagtgatccgcccacctcagcctcccaaagtggtgggattacaggtgtgagccaccgcgcccagccttataccatccttgaaaaggctctggtttctaaatgagtcctacgcatcagcctaaatcctactttgacctggtggaccatcttcacatcagcagggtggagttagcaccagcctctctcttgccccacatttaatcacccccaaatcattccagaatgattcggggcttcatgaaagagattaccttcctattgggtgtgcactcaccttcccatgccagttttcaacctggaaacactgtgattctgggatatttccttagaatgtaagctccatgaggacgggggtcttttcttttgtcttcttacatttccaaactcaattctattccctggtgcctggaacaaggcctggcacacagcagcgagcccgagagttcttgctgggtgcaggcctgagggtcagtctcacccggtcgtaagcgtacctggagacgccacaaacatgatctgtattttgacactttctcgccagttagacaagtcaaccagtacatcatgaaggacagaatgagagcgcaggctctggggcccaacacccatgttcagattccgctcctgccatgcatactcaggtgacctcctgtgtccattgacggtccagtggctcagaggggctgggagggccggatgcattcacaggtaaaggaagggtgcctggcacagaccaagttgcactgtacgtgggtttgcggctgctaccggaccaccgccccagcatcgtggcgatgactccactttatttctgctttcctacgtgggtgtgggcgttgatttcgctcttgtcctacctcaagacttctttagtgtgttcttttctctcctgtttaggctcccaagaaacatttgcaaaatgggattatccgtggctaccaaataggttaccgagagtacagcactgggggtaacttccaattcaacattatcagtgtcgacaccagcggggacagtgaggtttacaccctggacaacctgaataagttcactcagtacggcctggtggtgcaggcctgtaaccgggccggcacggggccttcttctcaggaaatcatcaccaccactctcgaggatggtaggttcggccggggcctggtcgtggcttttccctccgcaaaggttccctcgggtctgccccggggctcccccaacctcgcactcccccgccccacgactttgcagtgacctgcagggcctggggtctcgggtggaaaagccttccctcgtgacctcgcccaccccgctgatctgcccgccctggggcagggctggactgcaaagccagcaagtccctcccttttcagactcttcctcattcatttcaggtacaagaattgggcttttctggagtgaaaacaaggctctctctattactgcagaagtctcacgagaatgcagaaatgctatttgctaaaaaactttctcccaaatgttaagaaggttttttaaaatttattttatttttcattgtttcctattttcaagcattctgagtacagagaaaaggaattttcagattgcacagtgatcgatcgccccctagcggccgagataaattaattagcccttccaccatgtcactgagaataacccagaagctcaaatttccagtagtgcttgaaaatagagaaccctggtatccagaggcacagtgttttaggcaggaagttaagatatggggttatttgtagcaataagtggtagctttgaaggcaggaagctggcactacatttacctcttgtgcagttagtcatttgatcatagatttttttttgagacggagtccggctctctctcccaggctggagtgcagtggcgcgatcttggctcgctgcaagctccgcctcccgggttcacgccattctcctgcctcagcctcccgagtagctgggactgcaggcacccgccaccacgcctggctaattttttgtattattagtagagacgggttttcaccgtgttagccaggatggtctcgatctcctgacctcgtgatctgcccgcctcggcctccaaaagtgctgggattagaggcgtgagccaccgcgcccggcccttgatcacaggtttgcggaggcagataggacttgcacctgtaatatctgacaatttttgcgaggagaggagtcttcaatgacttgcagcctgaacactggaattgtctatcttcataattgcaatagtcgttaaatatgcctttgtttttgcttcaatgctcatttttcattaagatgcgtgtctcagccagtattttgcaccgccccagcgccaacatttaaggtttacaaaagctcagtactaaaaatattttcaatattcttctgacctgtctatggtctctcttccctctagagaaagggatgaggatgagacaggagaaatctatgattatgtttctactttttagcactttacaatggttcagcttccaatttatatgccagatattactaaatacagaggtaccgtactctataaagtaaatgcaacttaaagaagtaacttccaagagtaaggggaaaataaatcagacaaacaatgattttctactcaggcaataaaattaagaagggtacacgactcaagtcccaacaactgtcctaaaagtaaagaaactaagttggaaagagagactatggaatccattagaatatatgcattgactcatgatattttactgagcactgagttatcataagatttttccagggaagtgatctttgttattttttctttcattttggggttgagtgcaattttttgcttgcatattgaaatattaaaatacgttgctttttcggttattgctttgctcataaaccacccacagttattacagattctaattatttgatttcagtgcccagttacccccccgaaaatgtccaagccatagcaacatcaccagaaagcatatcaatatcctggtccacactttccaaggaagccttgaatggaattctccaggggttcagagtcatttactgggccaacctcatggacggaggtaagaggactaaactaggactttgggtttgcctccagagaatgcatgatggaatttgcagacccctcctagttcctaacaaggggctcaggatatggcgggcacctctttatcaatagacactttccccttttctgtcatccctcatctgacatttgaacaggtctctttgtttaaaacatcacacaccttcgaaacccaagttgaagcctaggcgggggcggcacttgggaaatttcaacatggatgtattttcctaattatgtctatgtcaaggctctgcaggcagcaccaaaacctccatctctatctagaacattctgtgtgatatgtattctaaaatgttggcctcttcctacttcccaaatagaactccgcggggaaacgttaaatttcctgtagttgtgctgtaagtgggtgtgggaagagtgcccaggcacatggaggggggcactcaggagggggccaggaagttcagggccctcccgttttgtctcctgtttctctttctcctcttccttccccttctcctcctctctcttttccttgttctttatcgtgtgtgtgtgtgtgtgtgtgtgtatttcaagtggtagggcaaaatgttcctgtttgtttagggcaaggctttgaataaacgactttctcaagtggacataagattggggccacaagtttcttgcagcaacacctcagtgtcttcgccctcaggctgcgagtggtgcccaccaggctgggccgggctgcgtgagtgtgctggggcagagcgaggctgcagcccccagcaggaaaggcctctggaagcctgctcactgtctctgtcccaagcctggggggcccacacctgcctcctcccctgccctccatttccagccccctcctgcaccccccgtcactggacagtaccttccctcttgtttggggtttcttttctttttttgagacagggtctccctctgtcacccaggctggagtgcagtggcacgatctcagctcactgcaactctccacctccccgggcccaagcaattctcctgcctcagcctcccaagtagctaggattgcaggcgtgcaccaccacacctggctaattttcagtatttttagtagagatggggtttcgccagcttggccaggctggtcttgaactcctggcctcaagtgatctgcccaccttggcctcccaaagtgctgggattacaggcgtgacccaccacgcccagcctggggcttctttcaacccctctgactgggtgtgatccctgatgagtgctcacctctaattttgggcaaatgcggtcaaggacctatcccttccctgctcaggaccacctggatctgttctaccaggcagacccctgtccccatgcaggtaaacatagggctccacaggtggcagcagcctccacggttggtgcaacagtaaaggcaagaagacacatgagcagcacaagcattactggctcagcgagcataggcctttgagccttagctctgcatgtccctaactgtgtccctaacatgtgtttctcaggactgagagcagacctcatgcctttgttgccacatgtagtacctggagcactaccagccatgggaggcaatctagaaggacccccccccgccctccttggtcctgcagtagacacatttgccaaacacccactcgacactgagctcatgggaaacaccaaggttgctgtgtctgtccctgtggaggttccagaccagtgaccgagggagatgctaatgaatacagaaccacagacccaagaagggacagccccacagaagggcagatttaagtagatgattctgtaacaccttcacccctcccacctaaacacaagttttaaaacaccccagagtaaagagcaatgaaaatttgcaaaagtcatctatttttatggacaaaataccataggatatcattacatatgtttcttctgatttctactccttatattgagtggatgaaattaaatacccttaatgttctttgaaaggcagtgttatgctaagatgtcttttctgttcttattggaaatatttcagaatccagtggtgacttcatccacatcacccatattttctaagctcactcacatttgctagcattgcctgctggtatcttcattctaaaatgaaagatgtggcttcatacctttaaagctttgaaaacttgaatattcaaaaacataattctttaaacaaagaaatgcttgggagtgtgcatgcagctttttaaagatactttcactcatgggattaaaatcaaagtgatgagataaatgtgcgatgtagaagtctgcacttcatttccgaaagataagcaagaaaccttcagaaacatgaacctgcctgcgaatggtcactcttcctgctacctgagagatttcgtttatgaggcaggtcagttcacggggctactggacacttttgcacaaactccccagactgcagcctccgggactggctggattcccacagacactgagcaggaagtgactgctgaccgacaccacatacacgtgcgcacacaccacacatacatgcaccccacatacaccacacaccacacataccacacacacacctcacaaacatcacataccacaccacacccacacatatcccacactcaccacacacaccacacctcacacaccccacatgcacacacaacacacatacacacaccccacatacaccacacataccacaccacgcataccacacacacacaccacacatacaccacatatcacaccacacacacatccctcatataccacacgccacatgacacacacccctcatacacatacacaaactgcatgtacatcacccaccacatgacacacactccatatacaccacataccacaccacacgtacacaaacaccacatacacctatgaaaggaaaatatctttttggcccccaaaatcactaaggaaaagtcaagctggaaactgctcagggccaacctgcctcccattctattcaaagtcacccctctgctcactgagatagatgcatatttgatggcctcctttggaaaggctgatcagaaactcagaagaacgcaacccttcccctctcacctacctgtgacctgtaagtcccctccccgcttcctgtcttcttgcctttgcttcaggttgtcctgccttccagaccgaaccaatatacttcttacctatattgattgatgtctcacgtctccctaaaatgtataaaaccaaactgtgccccgaccaccctgggcacgtgttgtcaggacctcctgaagctgtgttgtgggtacgtcctcaaccttcgcaaaataaactttctaaattaactgagacctgtctcaggttttcagggtccacataccacaccacacacaccccacatacaccatgtaccacaccacatgtacacaccacacatacacacaccacacaccacaccacacatcccacatactcatgcatacacacaccacacatacatacacacacacacaacacacactacacacacactacacacacaccacacatacaccacacaccataaccccaggcacatctcacatacaccacacaccacaccacacacaccccatatacaccatgtaccacaccacacatacacaccacacacaccacacttacacaccacacacaccccacatatacatgcacacacaccacacatacaccccacatacaccacacaccacaccacacgtacacacaccacacataccacacatacacataccccccatacactgcacactatgccacacatacagcccacatatactgcacaccacatacatacacaccacacacaccacacatacaccacacaccacaccacacatacaccacatatcacaccacacacaccccccacacacacgtaccccacatacaccacacactcaccacacacacctcacctacaccacataccacaccacacacaccccgtatatgtcacacaccacacatacacaaaccccacatacaccacacacactccgcatacatatgcacacacacacaccacacacacccccaatacaccacacactacaccacacatacacacacaccacaccacgcacaccccacacgcaccccccacatacaccactcaccacaccacacatcacacaacacatgtaacacaccccatgctactcacaacatatacctcatacacacagcacacacatacaccatacacacacaccacgcacacaggtacacacacaccatgcacatcgcataccacaaacaccacacacaccccccacacattcacacaggctgagaggggcaaatattgttactaccactgtaattagcaatagcccgaatactttccaaaatacgtctaagaaagaattctgttgttaatgtggtcagatgaaataaaactggttagtatatttgatagggaaggttaaataaacaatattttgatgaattttctgatttttttttcatggtcagaaagttaaatcatggttaaggcctgaaagaaacaatttatttgagattgctaggaaagttgtatcctttgaaaagttaccattttcctctgaatttttgctaacttccatctcatccatctttcttcatggaaaaaatggtacattctgaaaggaagcaacaattaggtgccaactggagtgtgtgggcagctgaggcttgcttcagaagctattcccgcacctattgttttctgccttaaaaccctctgaggatgaggcaagatataaatacacaaaactattttgtttaaaacaaaatttttaatagaaaaaatctgatttctaaatttattttatatatttttttaattttatttcactcatgacctcaactgaacaatacacttcagttaatgtgtgtgtgtgtgtgtgtgtgtgtgtgtgtgtgtgtgtgtgtgtgtgtgtattaaacagccctacagaggcatgaaagctagactgtagaaactcatgtttaaaaagaaaaagcgttaaaaagaatggcaaactaaacactcagttttgtatctggctttcttctttttcattctttgctttttatttcttccatatctgctagtcacctagtatctgtcatcaggaaaatagccttccttcacagcctatgaggcgttctagcagatagagccaactgtggctcaggtagttttagaaatcttaaaattgggattttgactgcctttgtcttcatggttcatgataaattagttaatcaaaataacttgaaccccccccccaatgttaattctaattagtatattaaccattagcatttttaatcattttgttttaagtgtttgcttttttttttttttttttttccttgagacagagtctcgctctgtcgcccaggctggagtgcagtggtgcgatctcgactcactgcaagctccacctcccaggttcacgccgttctcttgcctcagcctccccgagtacctgggactacaggtgcccaccaccacgccaggctaattttttgtatttttagtagagatggggtttcaccgtgttagccaggatggtctcgatgtcttgacctcgtgatccacccgccttggcctcccgaagtgctgggattacaggcatgagccactgcaccgggccaagtgtttgctttctttaagaagatcagagaggccaggttgtccttctccctccccaccaggctcctcttcctcattctgtctgattcaagagttgcattctgattcaagtatttgccggagggtcacagctttctcctatattgtgaaatgatcctactttttctgtgaggtggacaccctgcactcttgggaaaaaaagaccttcatcagagtctcataaccagctaccagcaccctgccctgatcagcccctcccctcagctgtatttttattgattgcgtgtgtatatatctgtagggaggtacgtgtgtgatctttgacagtgaagtttctaaatctgaaaagatcttaatgagttctatatttaaagtttgtccattagcatatgagtttttaattagtttgtttaaagacagggtctggctctatccttcaggctggagtgcagtggcacaatcacagctcactgcagcctccagttcctgggctccaccgatcctctcaccttgagctacttgggaggctgggaccacaggcatgagccatcatgtctggttacatttgggtttttatcctaatccaaaagacttatgttaaatatattcaggaaaaggaatataattgaatatggaaagacccgtccttcagagatgagaatttccaatccatctgggacaaccaagtattgatattttgactacctggtgaccacacatgctcacacagtctcctcattttcgtaagccctccgttgagatttccaaattgtgacctttaacagctggcaccctgctggcctccctagaagacaggagtccaaaggcctgtctttgggccatcctcgccctgctccctccccagcaaagccccagcctacagaactgtctgcttctggtgctcccaggcctttggctcccactggggcctggactgtgggagccacatggagcccctttacccctcttcttgcaactcctagaaggcacaggggctctctggcatgtgagggacaggcctcagccatcccatgcagtatttgccatgctcctttaatgctgtatccgttccacattgatctttttggtgacaaaaaaaagatgaacaaaagatgttccacagtcatcgtaatcacaaaatacatggctattcatttgtgaacctccatgcaatatcctggacacacaaaatacgtggctattcatttgtgaacttctgtgcaatatcctggacacacaagagaaaagaaaaacaatgagcaggaaggaaaaccaagacaggcaaaaagcaaaagcccgtttaatctggccgacacgacggctcgtgggtgcctccattttcagcccattttctgctttttcccagagcgactgaggagagcagctgagatccgcggcctgtgccctcagccactgtgctgggctccttgatcctctctgtccctcgacttccttgtctgtaaaatgaatgggttgcaaaagtaattgaataactctgctggttgtataagttactatctgtacttagaatagcatagcgctggcacctaggcaggcatgcatatcacatccactccctatatggaggccagggagagtgagagggattgacaagcagctggattgtcagttgacgagcaggtctgccaaatcagagctgttcaacaaggaactccccagacctgctggtctcttggggtaaccggcctgctctgggtaccaatgtgtcgctgacagccccttcccctaggggaacagttctcaggcccttctcatgctctgaaggcgactcatttcaaaacccatcagccaaacaccaaggaagtacttagcacaacattcgtaagttttctcaaattgccgtgtatcatatgctggagttgagagcgcatagtgttccatctgtgaatgttattagttgatcccactcctgaaagtgaagcatttttagctgacaccaagtttctgacacatgggcatgtcacttcaggattgaagctgagaggagttcactccaggtaaaaagaggggttggctgagccactcagtttagctcaggtgtatttttttcttatttaaatatgttatcttttcagctttattaaggtatagttgacaaataaaaattgcatatatttcagacatgcagcttgttttgatgtatgtatccaatgtgaaatgctcgccacaatcaagcaaattaacagcgggtccaccatctcacatagttgccattttcttcctccacccccaaatgatacaaagtttcagttatgcaagatgaataagttctggagatctaatgtacaaagtggtgactatagttaaagacactgtcttatagacttgaaacttgctgaagagggtagatcagatatttgggatgaagttaggtacttaaaaatacatgtatgttaaagtagagcttgtttaaaataacaataaaacccctcagcttgcagaagcttcctaatgaatagtcggcagtggggctgccaagtgtgcagcgtgtgtgtgtcgccctaagtgtgctgctaggggtgcaggggacattgctcattagcacctgctgaagggtgagtggcagccctggtgctggccttgggttgataacacttaacttggagcgaattacttcgttttccagaccaacgttctgccttgtgttctggagcagtttggtgtgaatgttcttttccaaagggccacgtgacaccatgagctcacaggatgactgtgcacagtccctttgagaattctcgtgtccagatgatggctggacgggtgatggcatggcacagggacagtcagtggggacagtgcggaaaaacgagcagaaatgggctcagaagtgggattttgttttcttgttcttgtcctccagagctgggtgagattaaaaacatcaccaccacacagccttcactggagctggacgggctggaaaagtacaccaactacagcatccaggtgctggccttcacccgcgcaggagacggggtcaggagtgagcagatcttcacccggaccaaagaggatggtgagagacgggtgggcggtgggtcccagcagttgctggaagggctgggtcacagagagctcacttgcctttaccctgcagttcatcaggctattctcagtgcaaacctttgctgccctcccaaaatatcccagtgcaattcagaccattaacttcctctcttgcctttgcttgatgtgtctaatccattgcttcttcttcctctatattttttcttctttcttttctttttttttgttttttgttttttttggccaagtattattgtaaatagaaactcattttatcctagagctgtaatacttgtcatacatgttttgtatcttgttagaataattttagtagctattcagctattagtgtaaactctgattaaatccatccttccacttcttgaaaattatgtacagactgaagttctattattctttgccagctgaatcactttagaataagtccttaatttgagaacttcatgttaattttttttaattcttgcaagaattcatggtgatttagtaaaaatttaaattgctgctcattttgttctacaacaataattcttgctgttccttacaatttggattgggttgtgactattacccaaacgtacaaaaaccatacaacaaaggttctgtattattttaagggaaactctgaggggccttggccaagcctgtttaaggaacagataagttctgataaatactaccgtggtagtgagaaaagtagcctccaccttaataaaggaaggagcaactgatgtcaaattgatgcccacatagaaccttcccaaaatattccagcacagaagtatacattgagatgagacattagcagatctaaatgctgtgctggattgtctctgcaacttttgtcttcttgccgggactctgttccccaagcagtacaggggcgggaaagctgttggccattgctggtcacctcctgtgtatgggcaggtttgatgtctatgctatctcccccactactagagtatcaaaaatgctgttattccatcccatatctgctctgatggaagcaaagaacacctgctcaggggccatgatacgctcttctcttcagcctttctgcccctgacaatgactccctgttattctgagcctgccatcttccacgtcactctctgctctcaccttggcaagccaggccttgctcctccgagcagccccaggcatccactctcacctggtgtttttgctgcctctgtagcccttctcacattgtaatgtctacacccaaactaatcctcatttgctttagtttttttctaaaatgcacaggtagtccttccagggaatgtgcaggtgtcagccagttctgctctaagaaattggattatttagggaatctaaggttcaaatgtaatgccattaggaagtcacacatcaatagagatatctagaaagctaagtcctgagtgaaggcagccataagttaattttttaaaaatgtaacagacaaacagctgtgcaaatgctggctctgtcacctgctgcccgtgggtctttgggcaccttacctaagtgtctctgaactggattgtcctcagggacaatctgctgtagccatcagactgcacagaaccagtgtatgagagctgaagtggtgtctgaaaacacctgcttgccacagagtgggatgcttcctgaccctcaatatttgattatttgctctccactccttcagagtaggggtgaaatactcctttttacattgctaggcaataatgcaaatgtcactggaattattatttaaagagcaaattgatcatccacaaaatgttttgcatctgcatttttggaagaatgtacagaaatccaataagaagggaaggctcttcacagatccttattaactcacaattttagatcaatttttaattaatattggagttttaagaatcatggagttctgtctcaaaacttgaccccaaggcccaaggtctaatttgtcaatcaattatgctttgcttttgtctccagtgctgatagtgtatggagctgggattgactatcgaaaaccctgccttgggtaccccagttaccccaaggaagatgccatgaatcccacttttgctggtggtatgggacaaggactatgcagaactgagtgtcaatatttctttaggataagtctgcattttcaaaaagaagtggagtggtggatcgcttgaggccaggagttcgagaccagcctggccaacatggtgaaaccctgtctctactaaaaatgcaaaattagccaggtgtggtggtgggcacctctaatcccagctactcgggaggctgaggcaggagaatcacttgaacccaggtggcagaggctgcagtgagctgagatcgtgcaactgcactccagcctgggtgacggatcgagactctgtctcaaaaagaaaaaagaggtggagtgaagattgggtggaagaagagaagaactagaataatatcacttcatctcccaggttcacatgaaaaattcaataatttagaaacggtgaagaattgtgtcaaccacttttgtagactcaatacctaatataattaggcatttcagcagtttacagaattaaatgctattttatttatctgattggaagaagggacaaaggacaattcagagaacaaatgcccagtcaaattgattacagatcgtatttatacttcaatgagaaagctttgtaattttgaagtttggattacacttacaatttcaattaaattgtgtaaaaatacagatagatttccagtaaaataataattaccaacatttgctcagttctttctcaataagatactattttaggctcaggttgaagtttcagcgtttatcaacgttcttgcaagcgaagaaagatagctacattaacagcgagcatccgattcagttgtctatgccagacacacgtcctgtaccagtcttcctaatctagggagcctggaggcttaaactgtgttattaggtcactggtcatactaaaaagagaaacttaaccctaataaaggcaaaattgtacttttgcaagggattatttgcaatagaaatatttgtttagaggacaagtctgtgcttgttctctacaggtagtttctctaccactatctaaagattcttgggctcatagtcatattcacagttccatggacacattctcatgtctgtggtcataatctcagggccatggacatagtctcttatccataactatagtctccggtgcatggacatattctcatgtctgtggtcggagcctcagggccatggatatcatctctcatccgtaaatagagtctcaggtacatggacatattctcatgcctgtagtcagagtctcagggccatggatatcatcttttatccataaatatagactcaggtgcatggacatattttttggggtctgtgactactgctcacagttcacgttctctttccaggactgctctatcagtgagaacttgtaccccattattgctgcagaaacacgaaggacgacttggtgatctggcttttctgtttttgagcacaacagcaactaaacctgacttctaaaaacagttgtgaaatcctgatgccattttatttgccaatactataatacgagtcaagccgtaaggaaagagaacacaaacaaaatgcaatctattaatcttccaattgctgttttcactctgaaggcaaaagctagtttcagccttgatccctttacacaagagtaaactttgcatatgtatcaatagagatagttaagttcaaatatttactgaacacatcactaatgcacctaactctgaaggtacatgtgagagggccagcagcaggtgtaatatgtgatctctactccctccccaccatcaattagcaatctcattgggaggagatctgaaagtagagctaagaggaagcaaaaaaataagctgacatctggatacctctgaatcttctgaccacccatactttgagccatacatacttgtgaaggtgtggatagtgtgtgcctgtgacgtgtgctggggtgactatgtgaccacacctcagtagacctgaaagggggtagattgcatgctatgtttgcatagccaccagtggtgctgcccctcagtagacactgggaagtactgccaatccacactgctcaagattccagtgctctatagcctatggtagtgtgccatgtgcagtggcaggtataccagcaacacgacagacaagatgtcctagaagagattctaccatgtggctttccacactccctccactgcagtggatcccaaactaggttcttacctcaaactaggtgggcctcagcagtgcccagtggtaagcaagaggcccagtgggagactccattctctccctgaccccagcttcaagagccaccccacttccacttgtgttatgtgctgggtttccacatgatgatttggttaaaggatcagtcaaacatttaaagaatgaacactcttgctctagtgagaggaaaggccaaaaatactagagtcttatggacatgggaagagaaaagggacatatgtgcatgcttggtgggatgacagctgtgaatgtgacatgtccctccaggatcgtagcatctgcacggcacggcatggctcaggaaaagccactgaaaagttgtgggttcagaaggatctggctaccatggtgtaccacatatgtacatgcatgtttgtgcatgcacaagtcacacacacacctgcctgtggctgtttactaagaccagaaaaatgatggtgaaaaaaaatgaagctgactgcggtgtctgtgtgggtgtttagtcagacttttgtccgatattcatacttcaaaacaaggcaatactgtttcagaaaaatgattgtggtatttttacattaaggtatgttacaggagggcttacccacttgtatttattttctatgctgtggaacagattgctacaaccttaacacgttaaaacaatacaaatgtcttatctcatcgtttctaagggtcaggcatccaggtctggttgagctgagtcccctgctgagggtccgacagatgaatcacggtgtgagctgggcctgtgccctcatctgaggtcaaggtctcccaggctcacaggatatgggatctttttttttttttttttttgtttggttatgaggctggagtcaccagcttccagaggctgcctgttactccctgtcacaccccctacagcatggtagcttccttcttcaggaccaataggaaagtctcacatggcttccaatccctctgacctcttttgtctctgacctccatctcctcttctaaggggcgcatctgattaaacccagcccacccaggaaactttccttttcattaactgaaagtcaagtgattagaacctcaatgatacctgaacaagcccttcacctttgccacatggcacaacctgcccatgggaggaatctgtccatcatagtaacagatgccacacccattcaaggggaaggaatcacccaggcacatacactagaaggtaaggatcttggggacccattgtagaatcctgcctaccacacagacacgaatgaaatcatttttccactcttggaaaatctgtattgaggatctagtatgttccagatactggcccaggaactaaagatgcagagaaacaggatgggcatggtggggtttgcaagctagtgggggagacagacgttgatagatcacccctgagtggactgtgtcaagtgcaatgatgaagaagagtctcaacagagacatgggagccctgacctgacctaagctggtgatcagggaagacttcctggaggaaatgacgtgtgctagaacctgagagatgagtaagagttgccaggaagaaggcagagggtgggaaaaactccagacagaggcatcccaaggccctggatcatggcatcccaagggcccggggtgggagaagcaaaccacgttcagggaactgaaacagagctcagtgttggggagcaccatcagatcagggggagagcccaactgctgacctgtcctgtccatgtggacctccaaagggcccatcaagtgacagcaggaagagaattccaggtcctggttcttgcaactgagaagatgatggggccatttcctgagatggggcaagagaagcacaggtttggatagaagatggtgagtgctgttgtgactatgtcggtctaaggtgcccgtgtgaaacatctcagccaattggacacatgagacacagaagcatctgcagctcagaagggatgtccaggtgcattggaggaatgtagaagagaggattctctgaaggccacattctttactgcaatcaattaaacttaaatgcagaactcctctctatgatgcccaggaattcatgaaaacttcccaagtttgttttgaccttcataagaaaaactcagattaccaaaatggaatgtggtcactaagaatgtttcaagaaaatatgtcccagacagacatataccgttttttactccatcctatgccatctctgtcttctgcaactctcagtgtctggtgtttgtcattcaccactgagtcacaaagtaaaggctagtatcatttagtgacatataatccaaggacataaggatggttattagagatgatagctagaacttatttggtgcttactgtacagagaacaataaataaatgatttacatgaattatctcttataattctaacagtaaaaacataagccagcacagttattattgtagatttataaatgagggaactaaagattattagagaagttaatcagcttgtccaggacgtggaactaagtgctagagccgcatgaaaccagcagtgaggctccagggcccacacctttaagctttatgatgttgtccaaaccagaactaaaatgttaagttctagctctgaaaagattagctcagtcatccagaaaaccttccaaaatgccgtgttcttcaacttatctatgttgttattttattgtacaaagttctagtaaccatacaaggaaagactgtgtaagatagatcataaatccatgcaggaggagccaactgcgagtttagatggtgcagtaaaagtcccttgatcggctgtgacacaggcatgctcacggaaatcatcacttaaaacaaggaatcaccaaactttgcagtggccaggaagtacctgaaatgttgcattttaacttaaaacatataaatatgtatttattccctaatcattctctaatcacatgacttaggatcacttcttgaagttttgggtgaaaagattggagctctgtgccatcttttactccatgaactgcatttaatgtgtagcatctgcatttttcaactggtgtctcaagtaagagcatgtgaccatttaccaacgatctgtttgcaaattgggacaaatccacatgtcccattcttctcagtggtcctgaccaaacatagatcggccttcttctttctttcctttcttctttccttcttttcttctttcttttcttttttatccttctttccttttgtcttcccttcttccttccctccttccttccttcctttcttttttcttccctctttcctttcttccttccttccctccttcattccttttgttcttccctccttcatttctttctctttttaatttcttttctaacttacctctaaggaaggctttccaaagtagtcccattaactgtcatagaaacagctttctcttgcacttgaatttcattggtttacgtaattaattaacttacagtactacccatgacacgtacaattgtcacaaacaggttggaaacaaatacaactgactcctcttcagcagccattcaactggttggtgctaaactacttggcctcctaaagagaagctgtccagcaagaatgttcactgtggtgaacaccaaccaggggctttatggaaaggactgagagtgttggctaagctggggtgtctactaggattaaaatccccaggaaacgttcactctgcccttgttgttcaggaggaaccctggcagctctgaactaggttgtggatgtcttagacattaccctcacctgatagaggtttgttctcaagggattttttaacccaggatctatcatttatgtgtgttaccttttctagaccttccactgttagcaagacttgccaaaaatggattaccaagattttatattttcaaatggtgactatgtccaacccaagttagttctcaccagagctcttggttttgttatgcagacttagaagagtcaaggtgacgattatgagaagcacattcaactccaaaacaatttactgagcagttgcattgccatcaaagcagtaaaagactcacagatttctccaggggcttgcaagggacttctattggtttgaatttcaatgtctccatcaatgtggttgccctccatatggacagtgaggttaatgagaaacaaagcaagagctctgatgccttcctcactggcacctttgacattttggcatcttcttgtcttggccatctcacccgccctcacctcttcaacctggaaaataaaagaacaagaggagtgggacatgccttcaatctcactcccaaatcatgcttagtattgctgccaccatgttctgccttcttagctggtttacagaggagagtttgtcttacatggatactgtgaatctttgacccaataatccctattcatcaacaatatttccatacctctcctgagcccaaagtggtgccattacaaaatgactagggtgagggagggtggggtctctgatggctgaggtagttcaccctcatgcttctcaaattcaggatccaaaaggttcatccccagtacattcaaagccaaaaactgcagcagaaatgagactgatccagaagttaattctccagttatccagaggcaggaagttgccaggggctgaaatgggttgggaagactccccaggacaagagggactagaactgactgtattaggtcctagagctacaaaggaccacagactccaacattaggaatttatttgctgtctctgagttctggaggccagaagtccaaaatcaaggtgtctgcagggctggttctctttaagagctttgagacaagcatctgtcctgggcttctctccttggcttatagatgccctcttctccctgtgtcttcacatcatcttccctctatacatgtctgtctctgtgtccaaactggccctttttataaggacaccagaagtactggattagggaccaccctaacaaactcattttaacttgattacctctgtaaagaccctacctccaattacagtgtcattctgtggtcctgggggttaggacttcaacatatgcatttggggggacacagcggaacccataacgctcatcctgaaagagctgaacagtaagtgcggagtggggtcatgttgggaagcgtgggtccgcaagcccaagttgaggccccaccttgtgactaaacacacggctcttccagttccaggtcctcccgcgggtgtgaaggcagcggcggcctcagcctccatggtctttgtgtcctggcttccccctctcaagctgaacggcatcatccgaaagtacactgtattctgctcccacccctatcccacagtaagttggtaaataaccaagtgcctttcaagcgtctgccagggacgagctgcaggtgctcgcactggacagtttcgttcctttgtttcccacctacctgggtctttccagtggttttgttttgcccctgctgtctccacatacaaaacaaagtcctcatttacacctcatttgaaaatacgctcctgaatcatgacaagggggacaattgtctggaattattgtttatttggtgagttcccactaaactgccagcagcctgatcaaaatcaaaacccagaggccttgattgtgccttaattgatagtcagtggacaacacctattgattttactgttggactcatcatgataagcacttcacgccttccctccctcccttctccctccctccctccttccctccctccttccttccctcccaccctatccctcccttctttccctcctccatctctcacagggaaaagaatagcaggcaaaaccctattgtgctagaaatgagggactttaatgaagatctattacccttacagttacagcagtcagcctggttcattgtgaaggaactaaaagttatttactatttcaaagtgtggtttttgttatcgttcatattattcctgctgaataatcattataaagttagactgcttctgagaccacaccaaaacatatcaaaaagggaaattttaaagaaaagaaaacattaaaatgacccaccaaaattgacgatgtcttcatggaaacattatgacattttctgcagcaggtgccatgtctcttccatctttgtatctccagctcccagcatagaacttgacacatgtagtcattcactaagcgtttgttgagtgaatatacacactggttttgtttcctttctggtaaaatacacataacgtaaaacttaccctcttgaccactttgattattgagttcatcagtattacataccttcacgttgttgtgaagccatcaccaccatccatctccagaactctacaaaaccgaaactctgtccccattaaacacgaattccctatcctccctcccaccagcccatggcacccaccattctactttctgtctctggatttgactcctctagggacctcatgcatgtggaatgatatagcatttgtcatttagtgaccagctcgtttcacttgacatgatatcctcaaggttcatccatgttgtagcatgcgatggaatctccttccttgttagggctgaaaaatattcccaaacaaatttatggattaatcttttaatcaaggtgatatgtttgcccaagctcagagtccacaggtgcccctgaggcctggtgtaccccaacagtgagtgtgtgagagtgtgtgggcttgcttggcccatgaagttccgtctgttgctgaaaaagcaaggtgtgttctctactgcttatgcattcatggcagtactctgcccttgaagtcaatatgtaaacgtaaatagtcagagttagactccacaacatttttctgggcttcttatgtggttttcaatatgctgttaatcctcacttactgaatcctactatcaaagcccagagatggagagcagcgtagacactgaaaaaaagctgagccattgtgccctcaatgcccagggtggcttctgcttttctgcttatcactgacatgtcccgtattcaccaaagagagacaaaaattattgctgaaataaagtatactcattttccactagaacttgaattgcatctgtattagtattcactcattcattcattgatctctttgctatgggattcacggttgctcttttgactctaacaggctagaaagcacctagcagggtatagaaagaccagcagcttcctctcgttttgtcttctcaatcatcttatctttatctctgcactaaaaatccctacctggcttacttgaaatgagtccttagtgactgatgcttactgagaaagcccctatttgtggatgatacaggctgtatttggctctgtcctcctggcctaagaattacatacaatagaaaaggaagaaaaaacatcctatcctgaaaacaaagtcacacaggtgttgttagatggggtagaaacgcatttccccaggatttctcctgtctcttcacccacagaacaatgggatttgacctgcccaggatcttaacaacacactctcaaaagggacagtaatgagggccagcaaggcacggtggctcacgcctgtaatcccagcactttgggaagccaaggcaggaggatcacttgaggccaggagtttgagaccagcctggccaacgtatgaaactccgcctctacaaaaaatacaaaaattagccaggtgtggtggtacatgcctgtaatctcaggtacttgggaggagctgaggcaggagaaactcttgaacctgggaggtggaggttgccgtgagccaaaatgtcaccactgcactccagcctgggcaacagagcaagactctgtctcaaaaaaaaaaaaaaaaaaaaaaaaaagacagtaatgagagcaaacccaccagaaaaaggtgggaaataacagctgagatttttatcagggtatctctgtgttgccttttgaccatattaaaaagactagagacatagaaatatgatgggcaggtgcctgtgttcttccaggagataatacctagaaagtgttacaaggaggtcccagaaccccagagcatcttaattgaagtgaagtgaactaaaaacagttccctctccatatccaccttcctgtctatctatctcaaccatcatttaagagcacgagacctattttttacatcaaatagtatcagtgagagtcaagctcagagacaattatttctcttcagaggtgaatacttgtaaatagtatccattattctgttttaaatatgaaatgatcaagaaactttaaagtacaggaaagagggtgtttttttgttttgttttgttttcatcagtttctgcaatttgactttcagtcggtaaactagatgctgtcaagttttccaaggcatttgcatttctggctatgtgtgcgaatgaccaccagaggacagtatgagctctagatattttccttgctcataaatctgaatttttttttctttgaaatgatttcatagttaaatgtagaacatagggggataaatcaggacacaatatgccttgtaatttggtcccttttataagagtccctcagctaacctcctcgctgatgtcattttctctcaagatcccaaattcatctccccttcttgggaaagaaccctgttaaaatagacaagcttttttctctaatatgtgacatataatgtctgctgataggcatttatttcatggtgctctctcagtttagcttagaaaaagacattagaatttgaaacttgcatgtggccagatgacaagttagggtaactgagaatgaatctacaaacaggttgtctaaagatgatgtggactgaacatgaactttccctcgggggtccaacagtgcaatgagatattaaactccccaatcagagattcaaactgcaaaatctcaaaagtcatttgattcagagcctcatccacataatttgtggattctggctattaattttaatatatagtggtttgaatgatcaaacaatctattataagcaatgaaaatccaaagacgtgagataacccttttaaggtcccaggaagaaaacagccaagcttcatttcctccccaacgctcccgtctacataaaagcagtctgaaaaactttcacaaacagactgcttttactatatacacattaaataagcattatgatatagacattgtctgtttcacaatgctaatctcatttgcggagcttagaaatgtaaaattaggaagcacagacttctcattaatgaaaactaaaaatcagaaggcataaaatatctctgagctgtgattcacattggttattccagcttcagatgataatgttattcagttcctgtacatagtaggtgctcaataaatgttgctgagttaatcagtgagaatacaccactactcttcttacccagaagacctgggcaattaagttctccacattgtagcccataacttagaattaaacaagtcttctgggaggcaaagtaactcaccaggtccagacagcttcccaccccaggcaacaggtgtgtgtttgcctcccaatcagccacagactgcatcaaataaagccatagtcaggctgagagcgaaaggggacttccgagaaccagaaatgtgcaggaatctcaaggagtggaaaagtggtataacgtggaatctggaaagcagcatctaacgtgctcatctgtatctacaatgatactcatcgctgtgttcattcttcctctctcacacggaacacggacctcctggctgtattaaaacgtcgttcctccctcccagtaccctccctatttcatgtcactgtagcatatagtgacgctactagatagcaatttgcttttaaaatcctccttctcttagcttccattatcatgttttttattctttgttgcttcttgtccctctgcttcccacccttaaatgtaggcatttcccaatattcttcctttatctcttaatattcttcactatctctgtggatcattgaatctgttcttataatgtaactatcatctgaaattaaagagttcgcattttttatctctatcctgacaatcttagagaaccgtcagtcctatatttccagcttaccaccatctgcgtactcaggaagacctctccagtacttcgcattcaatgtgcccacaaacacatttatacttgtgtctccctcttttcctgtgttctgatttagcttacgatctaacaaaatctgctgccttctgaccagaagccttcaagctacctatagttcctctcctaatcatttattcatttttaccacaaataaacatagagcactactcttacaccaagctctgagccaggttctgaatcacatcaatcaagagatgctgagttagggggcatcacaaacaggcctgaaacctcagtgatttacaacaaccatacaacaaccaatggttttatttttctttcacgatcatgctcattgtgagtatgtggtagtacatgccatgctatcttcactccaggaaggacccaggcaggtttcatgacaaagagaaagaaatctctgaggcgctgacataggcaggtaaacgctccaagcacaaatcacgagccagaatctgtcataagattctggtccatgtcttaaccacaaagggaccatgacgtacgctccaaacccatacccagaagttccagggaaggcaggaaacactagacaatgtcacccttctgtgtgatgtgacagaggacacagcaatgatgtgcacagcacagtgcaggagcgcggactgggtgtcactcaaacatacggccagagatggttgcttggaacacatagctagccctggcttgcaggaagagaagaattttacctgatgaatcagaggcaggaaagggtaatatgatcagaggaaataaatgagcaaagtgacatcatgtcacaagagctctctgcaatgtcttttttgttgtttgtttgttttgagacggagtttcactctgtcgccaggctatagtgcagtggcgcaatctcggctcactgcaacctccacctcccaggttcaaacgattctcctgcctcagcctcctgagtagctgggattacaggcacccgccaccccaccaggctaatttctgtggttttagtggagatggggttttcaccatgttggccaggctgctctcaaacttctgacctcaagtgatcggcctgcctcggcctcccaatgcaatgtcttcttaatctccttcctttcacacccaatgccattgccttgcttcaggtcctcccctggagaatcaaaaccaagtcagaagccttcccactgccaggctcaactcccagtctgttgtccacatccctgtcacaattcctttttccaattctgaatctgagcatgttatttcctagtgcaaatttattggatgacttcgcagtttttacctaaagacattcaaaattctcaatatgacctagatagatttccacaatccagctgcatctcctgtctagtttcatattctaaaaaccttcttccatccaatatctaagtaataccatgtctcatatgtgtctgcatttgtgcacgtgtgtgtatgtgtgtgtgtgtgtgtgtgtgtacacgtattgggtttttcttaccttttccattccatcctctttggtaaaaatgtttattgtttaaagctcaacttaaatgctgtatttttatttcaccactttttatcactggctacacattaggcaccgagtgccaaaagctttatacctatggtttttgaacttgccctatggtgacccacgatagaaaatataagttataatcacgccacgaaagtactcgcacaccacaaacttacatttactacacgtgatgccctccgatattttctgttccatttgactttttttctattctatttcattttgtttttaaagtgattgtcatgttccattaaattcctcctatgactcacatttttaaaaatactgttttgcatcagttaattctggtgactaccttacgcaggaggtgttatgattgttatcttcactcagtgatactgaaatgaagactctgcaatctggccagggtcacgcaggttagcaaaggaagatgggatctgcaacccacagcgggctgagctctttgtcctcatgcttacctgccttccctgggatcccagttccatcctgccccagtactcccagcactgactttcaacctcactttgacataaccacaatctcttgcgttattgttagacatgggcatagactggcaaacctggtattgtgctgaaatagtggatgttcctcaaatgtgtgttgaattaaattttatagatgatgactgtgagtcatctaaaagaggttaaattgtgtaatgaagctgtagcttaataaggcaagaaattgtgttatgtactttgggatgctttgtatcccagaaggatttggatcaagtgcctgtgcttttaaatcacttacatagaaatcattcttccatcattttatttaaatgacttaaggatgaatctttttttttttttttttttttttttttgagacagagtctcactctgtcacccaggctggagtgcaatggtgcgatctcggctcactgcaaactctgcctcccgggttcatgctattctcctgcctcggcctcccaagtagctgggactacaggcgcccgccaccatgcctggctaatgttttgtatttttagtagagatgaggtttcactgtgttagccaggatggtctcgatctcctgacctcatgatccgcccgcctcggcctcccaaagtgctgggattacaggcgtgagccaccgcgcccggtcgaatctctctctttttttttttttaataatggaaaatctgaaaattatggagataccacaagttggcctaaaaatagacaattgtattccatttacgcacatgtaatgaatcatatacatgagacctttgtgcagtgcttctacatggcaggcagatgctaggctctctatgttcttggatcaaccaaggattactgtagccccagcatcctgtcatggaatcatacggctggaaaaaacctcgaagggtttctttgaggcaaggctacatctaaatatcccagacatgtgaaaatcaattctggttttataaaatttcttgggaagtctattcctgaagctttcttggaaatatctttttatttcacggctagttctaatggaatgcagttcgttattttttcacttttaagttcaggggtaacgtgcagatttcttatataggtaaacttgtgtcacaaaagtttgttttacagattatttcatcacccaagtattaatcctaatacccattagtagtttttcctgatcctccccctcctctcaccctccaccctctgaaaggtgtgtgttgttgttgtgttgtgtgttgttcccctctatgtgtgtgtatgttctcataatttagctaccacatacaagtgagaacatgtggtatttgtttttctatttccatgttagtttgctaagaataatggcatccagctccatccatctctgcaaaggacatgatcttgttctttttcatggctgcatagtattctatggtgtatatttatcacattttctttatctagtctatcattgatgggcatttagattgatttcacatctttgctattgtgaatagagctgcaatgaatatatgtgtgcatgtgtctttataacataatgatttctattcctttgggtatatacccagtaatgggattgccaggtcaaatggtatttctgtcattaggtctttgaggagttgccacactgtcttccacaatgcctgaactaatttatactcccatcaacagtgtatgagcatccctttttctccacaacctcaccagcatctgttattttttggctttctaataatagtcattctgcctggtgtgagatgatatctcatcgtggttttgatttgcatttctttttttttattattatactgtaagttttagggtacatgtgcacaacgtgcaggtttgttacatatgtatacatgtgccatgttggtgtgctgcacccattaactagtcatttaacattaggtatatctcctaatgctattcctcccccgtccccgcaccccacaacaggctccagtgtgtgatgttccccttcctgtgtccatgtgttctcattgttcaattcccacctatgagtgagaacttgcggcgtttggttttttctccttgcgatagtttgctcagaatgatggtttccagcttcttccatgtccctacaaaggacatgaactcatccttttttatggctgcatagtgttccgtggtgtatatgtgccacattttcttaatccagtctatcattgctggacatttaggttggttccaagtctttgctattgtgaatagtgccacagtaaacatacgtgtgcatgtgtctttatagcagcatgttttataatcctttgggtatatacccagtaataggatggctgggtcaaatggtatttctagttctagatccccaaggaatcgccacactgacttccacaatggttgaactagtttacagtcccaccaacagtgtaaaagtgttcctatttctccacatcctctccaacacctgttgtttcctgactttttaatgatagccattctaactggtgtgagatggtatctcattgtggttttgatttgcatttctctaacagccagtgatgatgagcattttgtcatgtgtcttttggctgcataaatgtcttcttttgagaagtgtctgttcgtatccttcacccactttttgatggggttgtttgtttttttcttgtaaatttgtttgagttcattgtagattctggatattagccctttgtcagatgagtagattgcaaaaattttctcccattctgtaggttgcctgttcacgctgatggtagtctcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctaacatttaagtctttaatccatcttgaattaatttttgtataaggtgtaaggaagggatccagtttcagctttctacatatggctagccagttttcccagcaccatatattaaatagggaatcctttccccattgcttgtttttctcaggtttgtcaaagatcagatagttgtagatatggagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctatgaagaaagtcattggtagcttgatggggatggcattgaatctataaattaccttgggcagtatggccattttcacaatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcagttgtaaatgggagttcagtcatgatttggctctctgtttgtctgttattggtatataagaatgcttgtgatttttgcacattgattttgtatcctgagactttgctgaaattgcttatcagcttaaggagattttgggctgagacgatggggttttctagatatacaatcatgtcatctgcaaacagggacaatttgacttcctcttttcctacttgaataccctttatttccttctcctgcctgaatgccctggccagaacttccaacactatgttgaataggagtggtgagagagggcatccctgtcttgtgccagttttcaagggaatgcttccagtttttgcccattcagtatgatattggctgtgggtttgtcatagatagttcttattattttgagatacgtcccatcaatacctaatttattgagagtttttagcatgaagggttgttgaattttgtcaaaggccttttctgcatctattgagataatcatgtggtttttgtctttggttctgtttatatgctggattacgtttattgatttgcgtatgctgaaccagccttgcatcccagggatgaagcccacttgatcatggtggataagctttttgaagtgcttattcggtttgccagtattttactgaggatttttgcatcgatgttcatcagggatataggtctaaaattccctttttttgttgtgtctctgccaggctttggtatcaggatgatgctggcctcataaaatgagttagggaggatttcctctttttctattgattggaatagtttcagaaggaatggtaccagctcctccttgtacctctggtagaatttggctgtgaatccatctggtcctggactttttttggttggtaagctattaattattacctcaatttcagagcctcttattggtctattcagagattcaacttctttctggtttagtcttgggagggtgtatttgtcaaggaattttaccatttcttctagattttctagtttatttgcatagaggtgtgtatagtattctctgatggtagtttgtatttctgtgggattggtggtgatatcccctttatcatttgtattgggtgtatttgattcttctctcttttcttctttattagtcttgctagcggtctatcaattttgttgatcttttcaaaaaaccacctcctggattcattgattttttcaagggttttttgtttctctatttcattcagttctgctctgatcttagctatttcttgccttctgctagcttttgaatgtgtttgctcttgcttctctagttcttttaattgtgatgttagggtgtcaattttagatctttcctgctttctcttgtgggcatttagtgctataaatttccttctacatactgtcttaaatgtgtcccagagattctggtatgttgtgtctttgttctcattggtttcaaggaacatctttatttctgccttcatttcgttatgtacccagtagtcattcaggagcaggttgttcagtttccatgtagttaagcgattttgagtgagattcttaatcctgagttctagtttgattgacctgtggtctgagagacagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccgcttggtgcagagctgagttcacttcctggatatccttgttaactttctgtctcgttgatctgtctaatgttgacagtagggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttcaagtctgttttatcagagactgggattgcaacccctgcctttttttgttttctatttgcttggtagatcttcctccaaccctttattttgagcctatatgtgtctctgcatgtgagatgggtttcctgaatacagcacactgatgggtcttgactctttatccaatttgccagtcagtgtcttttaattggagcatttagtccatttacatgtaaagttaatattgttatgtgtgaatttgatcctgtcatcatgatgttagctggttattttgctcgttagttgatgcagtttcttcctagcctcgacagtctttacaatttggcatgtttttgcagtgactggtactggttgttcctttccatgtttagtgcttcctttaggagctcttttagggccggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatcagctcttagtctgataggctttcctttgtgggtaacccaacctttctctctggctgcccttaacattttttccttcatttcaactttggtgaatctgacaattatgtgtcttggagttgctcttctcaaggagtatctttatggtgttctctgtatttcctgaatttgaatgttggcctgccttgctagattggggaaattctcctggataatatcctgcagagtgttttccaacttggttccattctctctgtcactttcaggcacaccaatcagatgtagatttggtcttttcacatagtcccatatttcttggaggctttgttcatttctttttattcttttttctctaaacttctcttctcacttcatttcattcatttgatcttccatcactgataccctttcttccagttgattgaatcagctactgaggcttgtgcattcgtcacgtagttctcatgctgtggttttcagctccatcaggtcctttaaggacttctctgcattggttattctagttagccattcgtctaatttttttcaaggtttttaacttctttgccatgggttcaaacttcctcctttagctctgagtcgtttgatcatctgaagccttcttctctcaactcatcaaaatcatcttccatccagctttgttctgttgctggtgaggagctacgttcctttggaggaggagaggcattctgatttttagagtttccagttcttctgctctgttttttccccatctttgtggttttatctacctttggtctttgatgatggtgacgtacagatggggttttggtgtggatgtcctttctgtttgttagttttccttctgacagtcaggaccctcaggtgaaggtctgttggagtttgctggaggtcctctccagaccctgtttgcctgggtatcagcagcggaggctgcagaacagtggatattggtgaacagcaaatgttgctgcctgatctttcctgtggaaattttgtctcagaggagtacctggccgtgtgaggtgtcagtctgccccactggtgggtgcctcccagttaggctactcgggggtcagggacccacttgaggaggcagtctgtctgttctcagatctccagctgcatgctaggggaaccactactctcttcaaagctgtcagacagtgacatttaagtgttcagaggtttctgctgccttttgtttggctatgccctgcccccagaggtggagtctacagaggcaggcaggcctccttgagctgcggtgggctccacccagtttgagcttcccggccactttgtttacctactcaagcctccgcaatggtgggcgcccctcccccagcttcactgccaccttgcagtttgatctcagactgctgtgctagcaatgagtgaggctctgtgggcataggaccctccaagcaaggcacaggatataatctcctggtgtgccgtttgctaagaccatcggaaaagtgcagtattagggtgggagtgacccgattttccaggtgccgtctgtcacccctttctttaactaggaaagggaatcccctgaacccttgtgcttcctgggtgaggcgatgcctcgccctgctttgcctcatgctcggtgcgctgcacccgctgtcctgcgtccactgtccgacactccccagtgagatgaacccggtacctcagttggaaatgcagaaatcacccatcttctgcgtcgctcacactgggagctgtagactggagctgttcctattccgccatcttggctccacaccactgatttgcatttctctaatgatcagtgatgttgagcttttcctatgcttgttggctgcatgtaggttctcttttgaaaagtgtctattcatgtcctctgcccacgttttatcggattgtttatttttttcttgtaaatttgtttacgtttcttataaaggctgaatattagacctttgtcagatgcatagtttgcaaaaattttctcccattctgtcagctgtttactctgttgataatttcttttgctgcacagaagctctttcatttacttgatcccatttgtccatttttgttgttgttgcgaattgcttttggtgtcttcatcatgaaatctttgcccatgcctatgtcctgaatagtattgcctaggctgtcttccagagtgtttttagctttaggttttacatttacattttttaatccatcttgagttgatttttgtatatcgtgtaaggaagggagccagcttcaatcttctgcatatggctagctagttatcccagcaccatttattgaatagggagtcctttccccattgcttgtttttgtcaggtttgttgaagattagatagttgtagatgtgcagtcttatttctgggttctttattctgttccattggtctatgtgtctgttcttgtaccagaaccatgctgttttggttactgtagccctgtagtatagtttgaagtccagtagcatgatgcttctagctttgttctttttgcttaggattgccttggctgtttgggctctttttggttccaactgaatttttaaaatagttttttctagttctgtgaagaatcttaatggtagtttaatgagaatagcatgaatctataagttgcgtgggtagtatagccattttcagatattgattcttcctattcatgagcatgaaatgtttttccatttgtttgtgtcatctctgatttctttgagcagtagtttgtagttctccttgtagggatctctcaccatcctagttagcttcattccaaggtactttattctttttgtggcagttgtgaatgggagtttattcctgatttggctctcagcttgactgttgttagaggataggaatgctagtgattttcgcactatcctgagactttactgaagttgtttatcagcttaagaagcttttgggctgagatgatggcattttctagatatggaatcatgccatctacaaatagggatagtttgacttcctctcttcctgtttgaatgccttttatttctttctcttgcctgattgccctggccagaacttccaatactgtgttgagtaggagtggtgagagagggcatccttgtcttgtgccagttttcaaggggaatacttccagcttttgcccattcagtatgatgttggctgtgggtttgtcatatatgggtcataatactttgaggtgtgttccttcaataactagtttattgagagtttttaacatgaatggatgttggattttaccaaaagccttttctgcatctatttgagataatcacattggctcaaaataaagggatggaggaaaatccagtaagcaaatcaaaaacagaaaaaagcaggggttgcaatcctagtttctgacaaaacagactttaaaccaacaaagaacaaaaaagacaaagatctaactgtcctaagtttacatcatcctatattttacataatggtaaagggttcaattcaagaagatctaactatcctaaatatatatacatccaacacgggagcacccaggttcataaagcaagttcttagagaccatcaaagagacttagactcccacccaataacagtgggagactttaacaccccactgacaatattagacagatcattgagacaaaaaattaacaaagatattcaggacctgagctcaggtcctgaattagatggatttgataaatatctacagaactcaaatggatctgaaagatatttacagaactctccacccccaaacaacagaatatacattcttctcattgctacatgacacttactgtaaaattgatcatattaatcagaagtaaaacactcctcagcaaatgcaaaagaactgaagtcgtaacagtctctcagaccacagcacaatcatattcaaaatcaatactaagaaattcacttaaaactatacaaattacatggaaattgaatgacctgctcctgaatgactttgggggtaaataatgaaattaagacagaaatcaagaagttctttgaaactaataagaacaaagatacaatgtaccagaatctctgagacactgctaaggcagtgttaagagagaaatttatagtactaaatgcccacgtcaaaaagttagaaaggtctcaagttaacaacctaacatcacagctagaagaactagagaatcaagaacaaacaaatcccaaagctagcaaaagacaagaaataatcaaaatcagagctgaacagaaggagatagagacatgaaaaaccattcaatggatcaacaaatccaggagctagttttttgaaaaaaaaaataaaatagatagaccactagctaggataataaagaaaaaaagtgacaagattcaaacaagtacaatcagaataaataagtgggatgttaccactggccccacagaaatacaaacaaccatcagagaatattatgaacacctctatgcacataaactagaaaacctagaagaaatggataaattcctgaacacatacactctcccaagactgaaataggaagaaattgaatccccgaacataccaataatgagttctgaagttgaggcaggaataagtagcctaccaaatgaaaaaagcccaagattagatggattcatggctgaattctacaagatatacaaagaagagctggtaccattcctattgaaactattccaaaaaatctaggaggggggactccttcctaactcgttctatgaggccagcatcatcctgatacccaaatctggcagagatatgacaaaaaagaaaacttcaggagaatatccttgatgaacatcaatgcagaaatctcaacaaaatactgaaaaactgaatccagcaatacatcaaaaagcttattgatatagtttggctgtgtctccactcaaatctcttcttgaattgtacctcacattttctccatgtgtcatgggaaagacccggtggaaggtaattgaatcatgggggcggattttcctgtgctgttctcatgatagtgaataagtctcatgagttctgatggttttataaagagcagttcccctgcacaccctctcttgtctgccaccatgtaaaacatgcctttgctcctccttcgccttctgccatgattttaaagcctccccagccatgtggaactgtgagtccattaaacttctttttctttataaattacacagtctctggtatttcttcatagcagtataaaaatgggctaatacacttatccaccatgatcaagtaggctttattcccaggatgcaaggttggttcaacatactcaatcaataaatgtgattcatcacataaacagaagtaaagacaaaaactacatgattatctcaatagatatggaatgtggttctaaatcttctcagttttttgtgtgcaatttttgcctatttatttgacttctattctttaagaaagtggaagggaagtcgatgttgttttttataagtttatcatttaatagtggtcttttttccctgttatcctattcacagtgtctgttctcacactgctaataaagacatactcaagattgagtgacttacaaaggaaagaggtttaattgacttacagttcagcatggctggggaggccttaggaaacttacaatcatggtggaaggggacacaaacatgtccttcttcacgtggcagcagcaagaggaagtgcagaaccaaggcgggaaatgccccttataaagccaggtctcatgagaactcactcactgtcacaagaacagcatgagggtaaccacacccatgattcagttacctcccacggggtccctcccacggcacatggggattgtgggaactacaattcaagatgagatttgggtggggacacagccaacccatatcacacagtgaacaagccaataactactcaatctttctgttgaagctatatttcagttttcttctcatattgttctcagtggttgtttgtccactaggcattatgtgaaatcattcaattgctataactggtaaaatgcagatggcctatactcaaggtagaaatcttggcctttaaaattctgagcccaatcatgtaatttatagagcaaagaaaacttaagcatatactcccctaaaattttcatacagaaagaggccctggaaatctcttttgaagctcagtctcataagactgcctgcctgatttgtcagataacctgtcactaagcattctagctttgaggtagcattcattcagactaggtagcttagtgtatgccaccctgaatgtacttccccattgctgcgtagagctttctgattatccacaggctaaaatgcctttaaaaaacttgactttattttttaagcagttttaggttcacagaaaaattgagaagaaggtacagagattttccaaatgcccctgcccctactgcacagcctcccccactatcgacatcccccaataaagtggtgcatttgtaacaatggtggaacctacattgacacatcattattagccagtgttcatagtttatgtaagacttactcttggggttgtacattttataggtttggacaaatgtttgatgacatggatccaccattatagcatcatgcagaagtttcactgccctgaaaaccctctgtgctcctcctattcatcccaccctcttaacctctgatctttttactgtctccaaagttttgctaaaatgccctttttatcaattagcttttggagcttttggaagattgcagctttgaaaacatcttatctttttgacttggcctgacacagacatattgtactatttaaggaaataaattggctttaaatcatttttcaattaacactagtggaaagagctatttttttcaattttgtaaattctgcatatattatttttattactaagaattgtgtttctcattaatttcttgtatgtgagaaactatatgataacaaattagtttttttgtacagaatttgttgaataggtgacagcaatcaagttaaattaataatgtaactttgacagatagataattttcatggcaggtggtatgacaatgaaaaggggatgaggaaaaattgtagcaaagggagattatatcggttggaaagagcctgttaacataagtatctgtaatgccacctgggctaattggatggtgcttctaattctaaacaattacatcaagaaactagtttttctcatgccttctctggatatcaactttaatatagttgcaaaacattatagcaataacttttatatttggaaggccaaaaataaaatattttatatttgaaaggctttttaaaagtagccaatagtctatgtatataattatatatatagtctacatatagtcatatatatagacatatatataatggtatctatagtcatatatatatatatggtcatatataaaatattttatatttgaaaggctttttaaaagtagccaatagtctatgtatatagttatatacatagtctatatatagtcatatatatagtcatatatgtaatggtatctacagtaatctcagtgaaaggcagaggaaactaccagaattgcctggctgttatcccatttctaccaatgttggcctctcaacctatgcctttaggaagatctttctgccatgacatcttcttttatagatgggaactgtgaaataaaatggaaattagatcaaaatatattatacataagaattttaaaaatcttaaattaatgcagtgaactgctaattcttaatggaatccaggccatttctttgccactaaacaagaagatgttaagcattctaaaagttcccttaccctataattaaaagagctatcaattttgtttattgcttgggggagtttttttttcactgctgtggacattctatctatgaaatcacagccttcaagtttttttaattgcatgttaacaattagctatcagagctttttaaaacatcacatttccttatagaattagtttttcattaaaaagttaattgaaatttttaaaagtagaattccttttatatcagacaggctgaatagtttgacatgaacagcctatggctttgtagtcattttatcctcattatttcctatcgtactcaaatcatttctaggtcattactaaactcacctagtacaacaagaatttcttcagtgtattccagttactggtcattgagtcccagctctaagcaatgctctgaaccaggttccctgcagagtgagtagagggatgggtgagtaaaaggagtagagggatgggtcggggagcctgacccctggggagatgcagtaagcacatgcaagaccataacccacagtggaataaaggcaaaggctatgaaagacaaagggcagacttagcccctgattgagaggactagagaaggctctgcaaggtcttacaagtgcagctacaagctaagtaatgtgaggggttcggaaatgaatttggcaattattgggtaaacgtctagttttatagacatgaccaaagagtgtttaaagtgcctcactgtggctaattatatcttatttactggtcaaaagcatcttacacatgaaaagaaaaatattatatcaacaccacaaggcaacaataattgtggaatgaaggcaggtctagaagacgctgttcccaggctttccatgagttgaccctgaagcactaggagaaaactaacttcctcacaacccttacactcttttgactggaagagtaaactgtgcacatttagttccttaggaacccacgactctacccagcagacctaaagcagtaacatacaaagacaaaacgcttgaaatgtgaacgctctggcttgggtgtcacaagatttatcccatttactgtattttccactctggatacggctttggggaggcaaacatgtcagaagtcttgtaaaaccttgctataaatattttttaaaacaaatatatgaagtttccatttattttttaggcatcttataaatattcatccatgtcttcaactatgacagggttggttttagagaaaggttcaaacgagtttatatctaaattttagtaggaattggtcagacttctatggtgcctcattttaaattaatctgtttgccaagctgtggtcacttcttgctccccgggggcaggaacttgccttataatctacacactgcaactgaactcagtaaatgaccattaattgaaactcagtaattatttacaagcccttcctattacgaggcatgaagctaagaacttttgcctagattttcttcccacagcccaaaggagagaacgatagtccaacaagcttctatgtctggctcatggggtcctataactctcgccaacatcccttatccacagacctccatactttgaaggcagcagtgtctgcctggacccccccccaccacctcccacagtaaaaaccatgaccagcccactgtaagaatagtatttgagatggttcattacataagcaacatgcatattttacattttatgtgtgtgtcctcagaccaaatacccaaatcttcccctaagaacactgtggattgcccctgttacatgacatcggtagagcaggattccccaacccccgggctacggactaatactagggacctatactgcatgcttcttatgggaatccaactaatgcctgatgatctgaggtgaaacagtttcatcccaagaccatcccatcctaccacgtccatccatctgtgaaaaaaaaaactgtcttccacgaaatctgtccctgatgccaaaaaggctggggaccgctgagccagagagagccctgttcttctcatgccaccatgttatctggtggaccaagaaatcagtaacttggcagccacttagagcctttcaattgagaagtgattaattaataataaatgttggcttgcttctcaacttggatagagcctacatgtttaaacacattttagatgagaaataacaggctttttcctcagctagccaagaggaatatatgacagatgcaaaataattggcaaccccagtccacaaatgtcccatccacttcctcaagctgggcatagacagagcaggattaaaaataagccatggaagggaatccctggcattctggttcagggacatgggggatgggatccctcaagtccatgcctggcggcaacttcgtaatgttggctgtttctgtatttccacaggtcacaaaggaactcttatgtcttctcttcaaacaaatggttagcacaattactgtagtccactcaaaattaattcacactttaggcataacaaaatctaggatgactgacacgtctgtcttaactctaaagaagatgagactggagagttcaaagtctacctgaagaaaatgaaatatttaaatattaagaaaagtgtctctgttgcttccccacagatttctccttttgccacatttggttcattaatccctaagaaactccattgtgagtttgcccttctttataccgcagtgtttatctgttgtccttgatagcgaagctttgctttgtttctttaaaaaaaaaaaaaaaaaagattcagagtctctgaaatagcaacccagctgatatatcaggcgaaatctggaaatcaaagtgatcccttctcattgaacattctctatatttggaagagagtgctacgtaataaaatatgcatgtagaaattagcaagtcagtttacacactattggattgttgtgttggaaaatctggtatccaataaaaagaaaattaatgaaatataaatatagtccatgctatcctaacttaataaaatatggagggaaatatttcaaaaggagatgatatttatcatcccttcttttcagaacaagcatttttggctgagcattaaaaaggatttaatcaactagattggctccactacactgagagaacttctggttattttcttcccattttgctctttttttcttttttctcctacctactgttaaaatggttaataatgattgagttatgcaccatccatagctaatgattctgtttacaataaatactatataatttacactgcatccctctgttggaggcatttcatgcctatggttctctctctcaagacatccaggcttgctctgtcctctagggtcaaccagtaggcatccttaccctgcttcactctaggaggcgtggccagtccagcccagcctcctctcctgttgtgagcagggctaacctctgccactgtggttcgccattagccttctcaggtgtggctcacttaccaagctctgtgtccttcagactccaagttctccgagagattccctagagctcaaagccctcttccacccataagagggaatactcacagacctctctcaacagaaaatccttattcctgccccagcctcttttggagcctggaaatggatgactggcaaaacatgagaaccagcaagtcctgcccaggtggcctcacagctcttgttaggaaagaaggcactggcatctttaggagcattctcacgctttaagatcatcgctaaaacttccagagaacaggaagagtcaactttaatatccagttacatatattccaaagaaaataaatcaactctgatggtttaaattgttcagttatcaactttctgcttgcccttctactaagaccaggaaaattgtgcctaattatggcagtcctcagaggaatacacagtggcatcaaagggtggtgacatcagtgtaactaacttacccaaataaccaataggagccactaacagcttgacgttattatttttcatcctaacctacggagaaattaaggaagtttctatgaatataccttttttacttcaattcttgattagtcttctatataaatgatgaaacaaatcttgttgcataaaaagtcatattttattgttgattttagccatgcattatgttacaggcaaaaattaaagtgtgtgttttggaggtaatcaagaacgaattttaccttgtcaacaggataagtatggagttttaactaaaagctatgttgtctacacagaaaaagatctttattttataaatatatcttaatgctttcctgatgcttaatgttcagtaagagtaattgttagaatttgcacatcattaagctttgtaaaattaatttggcaatgacatagccttggagaatcacacaatgcaagtacatacagtctcaggattgtctctttggtttatcaggaaacaggccaaattccctctgaacttctagagggactaattttcccataatactctaagacgtgactggagtgttgtagtgggaggggggtggaggtgaggtgtaaatgagtgcatacacatgcacgtgcatgctagattatagtgatgtatctagggaatccatgcaagagtctctccaaatcatctgacactgtgtacccacaaattaaagttttgacaataagtaattatctgacattatgttttgttgaggaagcatgaggttgtatgacaattaagagatatagtgaagatttaaatcccctgtttaattgcatgactggtattgtaacttatgcagcctgctgaggcatgtaaggtttattgaaaagctaacaagagtaaaagtaagtccttcttgttttggtcacttctaattgacagcataaagtgtgaggaaatagcaccagacttgggaccagaggccctgagctggagccattgttctgcagttgtctggtcttgtgacatcagtgaatcacttactttctctgaacctcagtttcctgatctataaaatggatccagctccacctacttcacatggctttttaaggaacaattctgacctatctaggtctatgtctccttgaagttccattagttttgtttcatgtaataataaatcctaaacgtttattcacctaataaccaagcttcatatctttgaataataggtgaatattaggtgaataaatgtttagaattgttatgttctcttgatgaactgaccccattatcgttatgaaatttctgtctttattactggtaatatcctttgcttttaaatctattttgtctgatattactatagccattccatatttttttgattagtgttatcataggatatcacttaagttcctttatttttaacctatttgtgtttttatatttcaagtacatttctttctttctttctttctttctttctttctttctttctttctttctttctttctttctttttttttttttttttgagacagagtctcactctgtcacccaggctggagtgcagtggcacaatcttggctcactgcaagctccgcctcctgggttcatgccattctcctgcctcagcctccagagtagctgggactacagggacccaccactacgcccggctaattttttgtgtttttagtagagacagggtttcaccacgttggctaggatggtcttaatctcctgacctcgtgatccacctgcctcggcctcccacagtgctgggattacaggcgtgagccaccgcacctggcctatttcaagtacatttcttgtaagcagcatatagtcggatattgcttttatatcaggtctgacaatctttgcctttaatatatttagatcatttatacttaaaattattattactatgtttatgtttaactctgtgtagtgctatttgctatttgagttctgctgctgttgtgctacttgttgcccttgtcagtctttctctgacttctttggggttttttttgtaattccattttatttatcttattagttcattagctttattttatgctatattttgtaatttcagcagtttccttacaattcacagcatatacttttaacatcttagtgtactttcaagcggtattacacactttgcatatagtataagaaacttacaatcatatacttccattttttcctcccaacatttgtgctattgttaaacattttacttttatttatattatatacccacattacattggtattgtttttaactatcaaccatattttaataatatttaaataagaaataccatatatatgtatctgtataattacctcctttttctacttatttgtgtacatttatgtctctgtctatctggtattattttccttctgctggaaggactttctttaacatttcttgtaatgtgggtctactggtgattaattctttcagcttcttatgtatctgaaaaaagtctttattcactttcattttgaattatatttgttgaatatagaattctaggttgatttttttctttcagtacttgaaagaaatcattccactgtcttcttaccttgattgtttttcaaatgaaattggctgccatgcttatctttgttcccctttacacaacatttactttctctggctacttttaagattttctctctagcactgaaactaaaactcttgagtagtttgattatgatgctccttggtacagtttttttttttaatattcttgtggctagaattcactgagtatcttggctctgcgggctacagttttcatcaaatttggaaatttttcaaccactatttttacaacctttttttggtcctgtctctctcccctcctttaggaactccactatgtgcatgttaggcagcctgatatttttccatagctcactaatgccctgttaacttttttattctcttttctatgtatcatttattaatatgtgttgtgaacctcaaatatctgagacaggtctcagtcaatttaggcagtttattttgccaaagtgaggatgcgtgcccatgacacagccttaggaggtcctgacagtatgtgctcaaggtggtccgagcacagcttggttttatgcattttagcgagacatgagacatcaaccaattttttaacattggttccatctgaaaaggcaggacaacttgaagcaaaggcgggacaactcaaagtggggagggggctcgtgaggagggggcttctaggtcctaggtagataagagacaaatggttacattcttttgagtttctgattagccttctaaaggaggccatcagatatgcatctatctcagtgagcagagggataactttgaatagaatgggaggcaggtttgccctaagcagttcccagcttgacttttccctttagcttagtgatttgggggccccaatatttattttccttccacacctttaagttcactaatcagtttttctgcaatatctacgctgctgctaatcaagttcaatgtattttttatttcatgcattatagtttcattttgagtttaatttaggtctttttgtatcatatctacttaaatttttgaacatatacagttataataccgctataatacaattataactactttattgcccttgtttgcataaatctaatgtctgtgccaattatgggtgaattttgattgattgatttcttcttatgaattatgttttcctggaaatttttatgacagctttattgagatgtcattcacttttaacttcaacaattcagtggctcttagtatattcacagagttatgcaacccttaccactatctaattttagaacattttcatcaccctgaaaagaaactgcacgcccattagcagtcattcccaattttccccttcccctaccctgcccctgacaaccactaatctatgttgccatcgatctgcctattctgaacattttaaatgaagagaatcacaaatgtgtggtttcttataattggctcctttcacttagcataatgttttcaagatttatccaagttatagcatttatcagtacttcattcctttctattatctcataacactctgatatggcttggctccatgtccccagccaaatctcatctttaattatatagctcccataattcccatgtgttgtgggagagacctggtgggagataattgaatcatgagggcagtttcctctgtactgttctcctcgtagtgaataagtctcctgagatataatggttttacaagggggaaccccttttgcttggcctcattctttcttgcctgccaccatgtaagacatgcctttcaccttctgccgtgatcgtgaggcctccccagccatgtggaactgtgaatccattaaacctctttttatttataaattacctagtctcgggtatgtctttatcagcagcatgaaaatggactaatacagactccatggtatcgctgtgacatattatgtttatccagtcatcaggtgacacatatttgggctatttgtttgtggaaatattttagtaggtgttaaactttgtgaacttcaccttttggagtactacatgcttcaatttctataaattctataaatattcttgacctttattcttggatgtagttaagttatttaggaataatttgttctctctaagtcttgcctttaagaataattaggaaagactggagtggtattcagcctggggctaattatttcccctttgtggtaagacccttatgcactatacccaatgctcgaggaatcttgatgttttccaacccaactggtgagaacagccactactcccatccctgtgtgagcattaggcaccgtgacctccaattctttcaggtgtctttccctggccttgggtagtttcctcacatgcatccatggatctgctcagctgaatacccaagtaggaccctcttcaatctccagagcttgtcctttgtgtgtagctctctttccagtgctcttccttgtgaactctagcttccttcaggctctcagctctgcctccttagcttggaaaggctgccaacctcccgagttgaggaggtggagctctctattttatcagaaataaaatttacactgccctacaaattgcaaaatctctgcgattgtggggttttcttcattcgtttcccatctttcagagatcactgtcatttattacctgatgtgcaatgcttttagaaccattgttttatggatggtgtgtgttcctcagttgtttcaggtgggagggtaaatctggttcttgttactccatctcagccaaatacagaagtgctgtggcctgtaatgtaaaggggtaaattatttattggtggccatcaaagctgctgcagagaaaaatgtagatggtgggtcacttaaacttaccagttacattttatattgcaaagccagccttttagaggagagtgagttgagtttttttgttatgatatttaatatgttcatgaccattccttcgggaaatccatttttgccacatgcttctttgaatgtgggaacacttatgtctctttttacaggtgatcagcgagtttgaggcctctcccgactcgttttcctacagaattcccaacctgagtaggaatcgtcagtacagcgtctgggtggtggctgttacttcagccggaagaggcaacagcagtgaaatcatcacagtcgagccactagcaaaaggtaggcagtggctataaggacctcatttcctgttgtaacttgactgtttttaagtctctattttacctgaaataaaacttacactttcctaaaaatcaaataaaccagaatatcacattttagctcaagaaacagggttgtggctaacaagctctgagcttctgtcccatggaaaagtaattccctggaggtaaacacaaagctgagaatgagtggccttacaatggaagtgtctatgaaaattaggaaaggagccctcattcattccttggagtagctgaaaatcattacacggcattttcccaaggatgttctactttcagcaaaatcaggtatcacacttcttaatgagaaatgtctattttatagtctatggaatttgcaagcttaaaaatatttgaaaatcattcactatctgttgacagaatgctataagcaaagactttaagtaacagcaggaagtaggagtcaccaaagaataaaaagttccttaaagtgaatataatatcttcacatttgtacgttaaactggtccttaaaaagcacacgcaggcacggggtattcttgctcttctggtaatcacggccatccagtgtttccaggaaccccctaaattagcattcataataagtcaatttccttacgacacaattccaggccagcaggagttgcccctaattttgagttatagaacagtggcaacttattactaatatgttctctgatagcctgaaagacaagaatgaacattccaagattccaattttacctccaagaattctctgaaaaatgtgctttttaatgagatagttaagaaataggcagaataaagcagtgaggggaaaaaagaggggtgtcacattttgagctcaaatacagatagaaaataagtaagttggtaagggaaataaactgggggacttactttatgtattacactctttggtcatgatatccagccactccctgagaatgagaaaatgatgattaccaaggaaaatgttggacataaggactgagctgtgggatttaccaaaaaaacaacaaaaacaaacaaacaaaaaaacactgcaacaaaacacataggattagcaataatgtttcttcctttcctttgtgctttcaaagttctatctctagacacagccagaaaggcctggctagtgcagtggggtatgacttactcagtgggggaacaattgaaaactctcacagaagcaggtcttgcctggggaaattcaatgtcctccagtcatttaataagtcattttgagtgcctgttgtatgtcagggtctatgctggggacacagaggatttggtcaagggaggctgactgctgaaataaatgttccctaaatctcagtggcttcacataataatatagtccaacagaggtatttttggtcagggctctcttgggtggcctgttccacatggtgattcaggcatccaggccccttccaccttatgatttacaaccctggatttctcctcatttacagctaaatagatgggggaagaagggagtatggagggtttgatgagaggttttcatgagccagatacggaagtgtatacattatttttactaatatcctattgtctagaataaaggcatggacccaccagggaaaagaaaacagggtttggagagcccagaggagtcttttgagatggtttaagagatgtgttcactccctgaccccctgaagcttacagtttggtggggagccagtcagtgatatggtttgtctgtgtccccacccaagtctcatcttggattgtagctcccataatttccaagtgtcatgggacggacccagtgggaggtaattgagtcatgggagcaggtctttcctgtgctgttctcatgacagtgagtaagtctcacgagatctgatggttttgtaaaggggagttccaccacacatgctctcttgcctgccgccatgtaatacatgccctatgctcctcattcaccttctgccataattgtgaggcctccccagccatgtggcactgtgagtccattaaacccctttcctttataaattacccagtctcaggcatgcctttattagcagcatgagaacagactaatacagtcagtaaacaaagcatcacaaaagtatatgcatagagacaaactgtagtaagtgctataaagaaatagtgtgagaggacctcacctggagtgtcagatggaggacacacttggtccctgagcacaagcaaaggcggttatgtgaagagagaagaagtgagcagtcagaagctcctgcagagaaagatttagcaggtgggaggtccaggacactggaccctgctggggccggggaaggaacagtggtcccagagacgctgggaaggaagacagggacctgatcatgctgggttttcaacactgtgttagggatttcagattttgccgcaagagaaataaggagatggtgtagggttttaagcaagggaggcacatgatctctctttctctctgtgtgcatgtgtgtgtgtgtgataaaccttattttttagaacagttttagatttacagaaaaattgtgatgatagtacagagagttgccatttacctcacacctagtttccctttttatagacatcctaattaaatgcctttcttacaactaatggcgggtgtgctttttaagaccacctggtctctctgtcctgaatggactgcagagaggcagaaatggaggagggtggagaaggagatagcaagaatgaacacccaaattctcacatgagttagcataagtggaggcacgatttcttgatgaagaagaccatggaagaagtggattttgaagccagtgagaggaggtacagacatttggaggggttcaatccaaggtgacgaagagccattcactcagaggcatctgtgcactgaggcatgtcctggctctcaagagacatctggcaggaggcagaaattcaggcgggtcagcgtctggatatcgcttacacctgggatgggaatgagattggctgagagatggaggagagatgaaggtgcaggacggactctcaaagggagtgggagcaggcaaaggaaaaggggaaaagccagagaggcagcagagccaggagggtgttaggctgtggattcaaaacagatgcttgcaaaaggagggagtggtcaggtgaggctgctgctgctggaaagtcaggcaaaaccaggcgaaaatgcccctcagtggccacacggaagatcgtggtgaccttcctgtgagcagcatcagtgggtgtggaggggcatgcagaaatgagcctgagtcaggtgagaaagtgggtaggaggtgaggggcaggctgactgggcagaacattccttcaacacacatcacctggaagaagtgacaaccaagagaagaagctgggagggggagggaggctctcattcgaggaaaggctctgggttcattatttttcatgaggcctgccatcagagcatgtttatgtggtaacgggaagatcccagtagagagggagaaacgagaaatcaacaatacataagaaagagcccacgaccacagcactgaggtttagaggaggaaatgccagtaggttcacagatttggtggctggaaatgcagggttcctggatggtgtctctgaagcattaggcaatttggggatagtggagggaagcccagaagtgtgagaagaggagggacagcaggaagccatcgttgcagggaatggggaggacatttactaaagaaacagtaagaccagcagggagtgctgacagttcaattgaggttgatgatcctaaatggtggtcaatctccaaatgctctattgcgtggattttttttccagaaatgttcaacttttcatgcttaagggaggttgactcagggttaggattgctgtaggtaggttttctggaaaggggataagctagggagtgcctcaggatggagcagacagtcagttgggcagcccccacccagaagcccagacactggcaaaccatgaaggctgaaaggcccatcctagagggatggggatgtccacagcagaggagattgagacaggttattctgtagttgttgggaagtcaaggcagaccagcagcagtctagcgacaggtagcagggtccaaaattcagatacagttgaagaagaggaggaccactgcttttatggagggagtggcagaatggggccatggcactggtcctgggggaagcccctcctaggaaggggtccaggacacgaaggcacagagagcctggccccatggctgagaacaaacgggacccgaatcagaggggacaccaggttgcagaggggttcagtttctcatcagaatcacctgggatgcttgtcaaaaggcagatgccccaagtacaggaaagagctgctgaatccacaaggctgtggtgggaacctgcattttaaacaaagattctaggggattctcttggctgccccaggtctagtgtgttgagttgcccagtcatacatttctggctagagaccctttaaatttcagccgtctaaaatgggcaaaatgggcattgagcgatagcatgggggttgttgggcttgaagatgaagtagctctagcttgtattttttaaattgctaatggaaaagcattcataagtcctggagttaatttgaggggttatgcccagaatgttaaagaacaacaatggaatagagtggaacagagtcaaatcaactagactagactaaactagggtttaaaaaagacagaaaatatcagaatgcatcacatacagtgaagtctttattcatgcaactttgtttgcacatacacaacatcccaatgcatgtgtagcttctggagtttgatgtaaaacatatttcttaaagtgggtgactgttataaagctggaaagcccctaactctagctgaatttctctagccacccgccttttactgctgaggacattctctactctctaaagaactgtctgaagtgtgtgaaaaagaaaatgccaaaagctaccaatgcaggaaatctgatgctgcctaatcaggacctttttgttatcatgatgcaaaatcagaaatgtcaatgactgatgaaatgggccctgccttagaatacttcatctcagtccagggaaattgcttgaaacatgggttttgctgcaacaaaaaacaaggtccagcttctaagccctctggcattttctttttctctctactcttgcccacagtgcccagaggcaaaaatgtatgatttggtctggtagatcctagtgactaatgtgggtattctatactaggatggctgcataatgacttggctctgggtactctgcccttccagggattctagagcttccctgggggagccttctcctcatcttcctttgccaatgcaaaccctcaacccagaaatggtgcaggggtctcacatttgtcccatttttatgggctctgaatcagttcaaggctgccttccacctatggtttccggtctgtgcatccatcgagggtgagctcctgtaggggcacctgtttcctctatgtccccagctccatgacagtgtctgaagcatactggctaaaacaaaggacaggagaagccccgggctcctgtttacaccccagaaagtaatgtcccaatgtatggcaaagactgagcagattgttttcctctggaagacttgtgtgtggtgtccctgtcagcttttgtgactcactgatggaggtagcactagaacctctcattgctggccacactggacttcaaggcaagttcaccctgggctttttctgactgtcttctgggacttctgctaccttggggctgcaccagtaccagatgcccctggcagatgctcctgtttgggcatctgaatcactgttccaagcaaatggttgttcttcaagagaggccactctgaaaatgttcattctccttaatgtgtgtcctaaagatcaacttgctataatacagtcgggaaattgttaagtagaacttgttccagttttactccttcccgtctttggggcctttgtgttttgtattgtctactttctctgatattaaagtatattttaatgagcagtttttgtgttgaggtaaattgcttcctaaagtgctttgagaaataattgggctcatagaaaacacagcttggagctgcttggcttatgaagccctagatatttaatttggactcctcatgtttagtcaatagaagaaaagaatgctacaatgggaattttctgctagttgtgtgttcttacaatgacaattcctcataacccgggtaccagagagtagtgttgacagttgtaatgtgaattggcttcacatccatttttaggtattgcccttattgagtaggtcatgttggcctctgtgtagacacgtctgtggagtaatcaggattccactttgtttggttcctcagctcctgcacgaatcctgaccttcagtgggacagtgactactccatggatgaaagacattgtcttgccttgtaaggctgttggggacccttctcctgcagtcaaatggatgaaagacaggtaaccagtaacccaatgtatgccttcagtgagactctaagagattacatctgacatactcaggttgtgtctagtggtctcctaattttgtgtttatttatattagtgaaaactcaaggaaacctaccaattcttctgagatgagggcagagaaggaatctcagctttagcactgaaagggtctgatttattgtatcaaccctctgttaattcagagccttctagttcatgagagaatgcttgcaaggaaagtagttgaaccaactcaattattgtggaagtttgctgcaccctctcaggtaaattgtccatgtaactgagatgaatgcagccaaggctattgtgagatttaacacctatctcttcttctttaaagatagtgaactaaccataactcaaataccctgagaaagaactttaagaaatggagtacattaggactttgctaatttaaaatctggttctccatactccatagtaattatttaaataataggagccaagatagagggagagagtgagtgagatatggtctgtccatataactttttaaagtgctatatctctattcaggagaagaaattaggatataagttaagggtcgaaaattcatttatgagcatagaaatgtgatctaatggattcagaagaatgcctattttcaagcaaaagcacttagaaggcataaactgtagaaataatggcttggtgtagtgaccaaactgtagaaataatggtttggtttagtgaccacttttctcatacatttaaagttggttcatccaaatgaaatatgtagctcccaaggtcaagttggcattctgcctgttgtgggaatgaccccaaaggactggacaatctgccaccggagcagtggttatgatggccacgcagttctttttatactagggtaaactcatcaccctcttgagatatcacatgtcatttttcatgtcaaaatcatgaataattgtgactttaagtgaatctaaaaatgatcccaaggtttagtttcccctgtatgatttgttcaaactggcacttctgcctacagaagaaattcccagaattgccaaaatgaggatatctccagtgcccacagagtggagtaaagagggacccatcagtctctggcacagatgaggagtccactgacttgagccagaatctgggcccttgacacagatctcatcttcaacgtaacattttttacaaaggaaaacttcagctacacagctattgattgttttcattatgtaatcatatttagttctttcataatgcaagaaatatgaagcttccaaatgtgtggtttgcttcacagagtctttctgtttttccccaacctcagctaatttggattgtaatttctttaatctgtgcatttttcttcctgtgaggcagtaacgggacacccagtctagtaacgattgatgggcggaggagcatctttagcaacggaagcttcattattcgcacggtgaaagcagaagactccggctattacagctgcattgccaataacaactggggatctgatgaaattattttaaacttacaagtacaaggtacaacatttgaggactctttttaatgatatcttttacatgtatgctttctatgcaaaaagtagcactgaacaaattttaaaatcagcccttataaagagctaacttctgtttccatattacagaaaaagaaaacacatgttcattttgcaaaatataattaaacaaatcaaagaaaatacaaagcattcacaacctcagaaatactgagatacaaaacatctttgcatacagaaagcctagtctcttttttctttatgtgtacatgtctaaaaaagtccttcttaataatttccattaattgcactgtttactctacatatatgtaagtgtatcccagaaaacacaaacaaaaaacaagtctgaattgtggtcttttttgtatgctaattaactcaatttttatatgcaatgtattttaaaaaatgaaagtaactggagctctaagtagatcgctgtagtatttagctatgtatttaatactaagtatttttcttgatatcatacacaaaatgtgcacaacttcaaaagattgtcatgttaaaattttgtgtaaatcccaatcaataagtgattgagttcagatttgtatgcacagcaatattttattagtagaaaaatcaaagtgtgtgcttctttggatttaggtgttgtcacattaatagattacagcaagtaaaaataaaatcaatactgttctcggtgggatggaaggaaaggaaaagaactatatttctaaaaatgctgcaaaattgatcttgaatttcaaattaattgaagtcaggagaattccagggaattttggaagacaggcactatattatgactctgaagagataggtcaatatattaggcttctctcagaggaaaagagaagggaattttatatgaagctttctatatgatttggataacctgattctgaatttctttagtgtttctgccctcagaacccatccagacttacttaccagtatgtattctacaagccttgtaagagagaccagttcatattctgcagttcaaaggcctgcttttgattttctgtgtgtgtgtgtgtgtgtgtgtgtgtgtgtgtgtgtgtgtgtgtgtgtgtgtgttgcatcttggagcaatagcttagaaagtgaagatttttgcaattctttttcccactagctatttttcctccttccccttttccatcctgagaagaacggaactgctaagtggatgccatttatctttttcacttaaatttcatggctgaaattcatagtaaaatgaggcatgtatccttagtaagtttaaagaagatttcaattagtgataaataactcagacagtcaaggaactggtgaggaaatgagttagatatgaatccaagtagaaatgtggctgaatttttttttaaataatagattcactccgttctatctctttagcccaggatatcaactaaatagacattttgacagaagtgaattgtatattttggcaaactgaaacacttatttaataaatggctgttaaaaatgagttggtaaatgactgttcaggaaagttaaagatgtgaaaaactaattcttgttttctaaaaactgtttcctctccagttccaccagatcagcctcggcttacagtctccaagaccacgtcttcctccatcaccctttcttggctccctggagacaacgggggcagctctatcagaggtaataagatatagattgtccacaatagttgattagttgtgtgatccacatgccaataagtgacacatcttcagcaaatgactggtatgtgttactttattctcccccaaaaatacgtcatataaacaatccctccattacctaagaaagaaaccatacatttatttttaggatatttgttgaaattcaaatcattcatccaaggatgctcatttaagagtgaaatatcaacagttgcaagaaagaaagaaaaaagaaatttggatatctcttttttgagattctaaacactgtttcttttttattttgtcaacacaaagtcattcatttatgtaaccatgggtactgtcctgacttagaaagtaataaaagacagaggacctaaagtgtagatgtaaaacaatctatttgcacaaaacctttgcaattagttcatagttgaggtgtataaacaagattttgttttgttttgttgttttgagatggagtctcactctgtcacccaggctggagtgcagtggcactatctcagctcactgcaacctccgcctgtcgagttgaagtgattcttctgcctcaacctcccaagtagctgggattagagacacacaccactgctcccagttagtttttgtatttttactagagacggggttttgccatgttggccaggctggtctcgaacttctgacctcaggtgatccgctcacctcggcctctcaaagtactgggattacaggcgtgagccaccacgcccggcctaaatgaggtttatatggaaggagtgagcatggtcgttctagtgtgggtggagttaagctagagacagaagatacacaggaaagagggcctgtaccataaaggaggtcccagggccggggagagagaataggggcttagacttcctaaggcagagaacatcctttcttctgagagagaaagaaggctgggaagtaaacaggaagtcaggagcatttcagagtgacatcagtagtgtgctggagcagctccttccagctccgagagtgaggtgccacatcccttcccagcttcatgctcagtggccacagccaccctaagaacattccctcaccatggaaatcagaaatgctacaaatcagagccttttttctcctctccaagaaccagttgttaaacatttatcagcactccaatgggtgaagggaagatcttttttttttttttttcttttaggaaagaaaaagtgaggtgatttttttaaaatcgtggtgaggatgtgtctgtggatttgaggagcatgggataggtttgtaatagctgccttgtggaatgcacagagagtcattaatagatgaaccgagtcattgccaagaagcttgcaaggacccagctgcagatgcacagcacaaattgtacgagtcacaattatcactgtctaatgactttcttttttgttttgttttgttgagacggagtctcactctgtcgcccaggccggagtgcagtggcacgatctcggctcactgcaacctctgcctcccgggttcaagtgattctcctgcctcagcctcccacgtagctgggactacaggcacgtgtcaccacgtccgactgattttttgtacttttagtagagatggggtttcaccatgttagccaggatggtctcaatctcctgacttagtgatctacccgccttggcttcccaacgtgctgggattacagtcctgagccaccacacctggcctaatgacttttctaaatgattctggacagctgggaagaaaagtggatcacagattaccagtaacataagcattgccagaagtctgaagagtgagagaaactaggctccttgttgaaatggcctaccaaaggttccaggctgactagagaaccttcttataggaaaaaaatagggggcacctagggatgggctcgagggaccctaggttttaggctcaaatgaaatgaggcttggattctacaagtgtgagagcatgggagaggtagaacaagaagggtgtgtcagagcacaaggtcttccagatgaagccagttttagtgagggagagtttccaagacaaaggtaacccagcattcctgaaacacagtagtggccaaagccattgccatcatcaggaggtgtcgtaagttgtgtgcccacactgatggacactgatggcactgaggatgatagcaggggacagggaactatacaggcctatcaccaaggattagaggagttttttgaggtggcttcgagggtggaaagtgggaggaaagcagagtccctacaatgtgtagggcggctggaatacaggctgggatgtggctgggagcaggtgcacaggtatcacctgtcaggtactgaaggagctttatggaggtcagatgaggaacacaaaggctcaggaaggaggagggaccctatggccacagaaggccagtggtgagggaaggctgaaaggagtaggggagatactgacaatgacctcagaaggaggcatcagagatgagtgatcgccatgtaaggggtgtggaaatcagcaaacctgcccatttgggtttaggagacactgtagtgtgcagggaaaaaaaatgctttatttttattaaaatggagctccacaggacaggaatagaaggtaccaacccgttgttgcaaacacaccatgttccaggccagctagccagggtggagaaggaacatggctgcagataacagggctgaaggagttaacaggaagaatatttcagcattcacaggggtgaagaacatgggcttcaggctgactgcaggatctgcatcctcctttcagcacttgggactcaccgcttaactgctctggacttcagtgtcccacgtgttctgtgggagagtcgtcactgttccatagggttgcagaaatactgtaagcaaagggcttaggacagggcttggcatggagtgagtgctctagagtggacagtcatccttactagttgtaaaagtagaggtagtgctcatgtgggggaatgaattgttggaggaatttttcaaaccaaagagaagccaggttactgtcagaatagtgggatggctgcaagacttggagctgtttctcctagtgtctgtgaactgtgagaccaggagtacatgaggagtgaggcagttgaagaaatctctactcccattgataatgtatccctttcccagagattcgagtgtcttgcaaaaataacagcttcagcctatgtcttcactcaaggattcaggcatgtatgatctgagggacagatatttggcaacttaagtattccctgctgctcaatatggcttttagaagagaatgagcagaaaacagcaatacttcacagtgataatgtctggtgtggcccaaatgactcactaatcaatacatcatggtgcttctcccaggctgggttacatttcctggaatcagaaagagcgaaaatgttccttctgaagattcttcagttctgagaatgctcgttctattacccacacaaaatgcaagcatcagtccacttcccatagaaagcaaacacagtgctcatgtgaatctttctcattctctgcaggatacatactgcagtactccgaggacaatagtgagcagtgggggagttttccaatcagccccagcgaacgttcctatcgcttggaaaatctcaaatgtgggacttggtataagttcacactgacagcccaaaatggagtgggcccagggcgcataagtgaaatcatagaagcaaagaccttaggaaaaggtaggtatgccttctcatcgcttcttaatatcctttcttttcccggccagaagaggagattggaatcataaaagatccatcatgttttacgtttatgtgtttgaactttgtcattcctcacatggcttcagcagtgccacggcataatgagagggacagctggaccttccagagtgttctggtcctctcttttattgtttcatttgcagttaaaaagaagaatgtcagtttgaaaatcaagggcgttggtgtgaatgtgaggtgccaaggctgggcagccatgaagcgtggcgcttgccctctcagccgtttggaggcgcccttctcccttagccacccttgctcccaccttcctatcatttccacattgccacatagccaccgcttttcagagggaaaatgatggggtaaattgcgtttgttttttttttaatctaaaatgtggactttcaaggagatgaatcccaaagaaatcatattcagagaaagaggttttgtcccaggaactccagaaggaaggagggatgatgcagctctatgtgggcataggaagaaggtgaggagatgtctttgcaggcttccctcccataggagtcctaccaggtggggtggggtcagatggcaggagagcgagtaatgagatagcaagggtattatttgtgcctggtgccacagttttgggtaacaagtggtaagaggtcaaatgatcggggattgatttatgcagaaatatatcctttaggtccctgggcaccaagaccaagtgtttagttgtggaggaaaatctgttggtgcttcccaaatccaactctgtcttctcttgaatcaggttcatcacatgaggatggaaaaagtgcccagcacactgccccgcaaaccacagaaggaaacccatatgtgaacatcctattgttctttagggaactctaagataccccaaaataacctccacccatgcaattttctgtcacacacccaggtcattacagttggagaaagcctgttggtccataaagtctctattaacaggggacaagttgccagtggcctgtgagccagacttggactgagctcctggcctcgctggaggaagcagtccgagggaaatgcgtgaagatgctgatggcctccccatgtgtcctgtgagctgacctccatgtgccttctcccccagagccccagttctcaaaggagcaggagctgtttgccagcatcaacaccacacgcgtgaggctgaacctcattggctggaatgatggcggctgccccatcacctccttcacactagagtacaggccctttgggaccacagtttggaccacagctcagaggacctctctctccaagtcctacatcctgtatgacctgcaggaagccacctggtatgagctgcagatgcgggtgtgcaacagtgcgggctgcgcggagaagcaggccaacttcgctacgctgaactacgatggcagtaagctggctggctttgtggctctcctgcttgtgtcttgggggatgtgcacgtgggccctgcccctttcccatcgaacatcatctttgccatagtttgaccagtgcccacggagcccattaggctttcgggattcaatggactctgtctggggctccctagttcgttatatccagatgaccatcactgtgtgtccagaaataagagactcagggccatagggagtctcactggggagtcatggggcaggagtgatttctcttagggctgaaggactcttgaccctgtggttctgtgcttgtgttgatgtctatgagctaacattgcttttgttgtctcccacccctttccccacctcatcccaatccacataacaactttcttttttgcactcattacaccctaaactgcatgtgcaaaaacaattttccatggtaaaggagcttatgttagtctctgggcaggagcagggccactgatggaaataggataataataggaatccatgaacacgtgcacacacacaaactcacacacacttgccacttgcatttactttccaaaaactaggtgaggtgtctcttgacattagttaaccaaaaataaatggtttaaaatctcactcattttttctggtatcaagggccatttattgctaactgaacaaatgctaagcccagtgaagctgaaaggagcgagtcctcgactgcaacttagtaggggaactttagaaagtcccagcagcagcgggctgatgctcatttctcactaggggaacagcaaggattgagttaggtgctctaattgcaaggtaaaaacggcagcaatgcatcaggatgagttggaactccagtgcaactctcctcagagccttctattcactgcctgttggtcaggctagaccacagtgttgaatgagttaaccaagaaacacccaaaccctttattgacagccaagccaagaccacgttggaagtgctcctctacctgtgggtgatgctttgtgaggggatgcctttcaatgaagtcactcataactgagggctgtaaaattagacagaggcagcccatgaaaagcatcagcattgctctctaggagagtgattctttctttactttgtgcatttgggaggccgctttattaaagctccagcaggtagctccttggagcacagtttatgccatcctaagaagagtggctgtgaacctaaggacccacagaaatgaccaccaggagctaatgaggtgacattgcctgggattttcatcggaccaatttctcctataatgtccggatggcccagggctggctcttcttgctttggcacacagagcagacctaccccaaatctcctgtccaaggtcatttttccacaacatccttctctgccagagtccagggtcttcctggcacttctggcctgggtctcagggctgtaggaagaccttgagcttgtagaaagctcttctagtgttggttacgctagccggggtccctggcctctgcacgggctctgtcctatggccccagaatagcctatgccctcccagacgacaacttttctcttcaagggctgatgcttttcatgggctgcctctttctaattttatagccctcactcttcagtgacttcattcaaaggtgtccccatcacaaagcatcacccagaggcagaggagcacttccaagctggcctctccctgtaatatggttgaattatttgatcttacaaaataaagaactttgacacttaccagacactttacttagcatttaagggtgcaccaaaatcctctgttaaccagcacacatttgagtagtaagtatcttttttactttagatcattatcttgcaatattcacactctggttcccagcttctctataatatgtgcagatgcctgggcacccagcttaaatgtgcacactgatgatatgctcacagctaatgatttaattagaaactactcatgtgtagaatttgaaactgtgattctaattcacaaagtgttctgcggattttaaatgtttgtcttctaagaaaagatataattttctcactttatccaagatcccaaattttgaaaaatgctgcaagctacctttacgttttggaaatatgaaatcactttattacactaagaaatatggctgcatatttatattttccttgagagagattacagatttctttggaccagtctcatgaatggatagcctctattgtcacatctgcctgaagaactttgttatcttgagaaagccaagattggcagcctacattcataccactcaggtttcagagtcctccatttaatgatctcactctttcttctgccatttccttagccgaatgtttctgcttgacctagtgttgtcttggttttgcagacccctcttcatgggcatcctgtaagtgcctctttcctgaatttctaagcatttggagacttgggcttccacaaaaacactttaaagttgggagaacactcttctcagctttagcagagatcacagaggaacgaggattccattatccctgctctgcttactaaatgcaggataaagaccgttttgctgagggagaaattatattatttttgcattctcttttcctgaagtgctgactttctggcccttgttgtacatggaaagtgcagtggcgtggagcatcttatataatggagggtagcaaaatatatacctcataaaaagtggatgcctgtgtttagatctctgcacccacggtactgagcatctggatagaaggcagcttaagatagctcagagttcatcttccttcagtgtttccttattactcgaaataatctagattttgtagcactatttaaccatgcctgatcaaaagtaggctcctttagaaacctagttgggtcccctttgaaaagctgtctgtagctcttgtaccctcaaaccacagctgttgaagtagatttggtcttacacctgcgataaaagccagcaaattacctaatcacaagggatttgagtttctttatgccagtgtatctaggaccctctccctgcacacgcgcttctgtccatttgcccaaccttttgttcattctttgatgtgcaattttttcgaatagtctctatcaattgtactgtgggtgacagtcaagggaacacttaattctgggtagatgcatgtggcttttgtcagcaccaagcctgggcctcatgctttcaagtgcctgcacactgtagtgcattgcaaaatgaagtccttttcaaacgtgcactatagaataagttggaagttcaggcagagggagggaaataaataagaaaaaaagttagccagggcctagagacagagttcttttcatttctcatcacctccaacacccttggatcacacagcgcgatttttataacctgtcatccctaaaagctccgccatgccgtcttcattaatagccatctaacaccgtggccctgctttcaggtacaattcctccactcattaagtcagttgtccaaaacgaagaagggctgacgaccaacgaggggctcaagatgctggtgaccatctcctgtatcctggtgggggtcttgctgctgtttgtgctcctgctggttgtgcggaggaggcggcgggagcagaggctaaagaggctgcgaggtaggtccaggcccagctgtccacctacgcgtgtcccctgctgctctgcagccaatgggagagatgccagctggagaacaaacctcaaaagggagtgactcttccctctttaacccaggtccctccactgcctggttctctgacattccttcagcgagactgcagagcctcagggaagagcaataagaatgttcctatctcggtcagaaatcaggtgaaagccaacctgtcccctaaatcctagctgttggtatgcaaggaaaattaattttttaactctagtctcttaaattttcagtgggtccagcaaagccaccaattgtggctttctatgaaaagatctatcagatttgctctgggaatgagaattacttgactgactggaagtggaaattgagggcttaggatactggtgaagcattgtgaggcagaggacacatgccatcccaaattagaaacgggagctgaagcccagtgtaagagtttcactctaatgtagcaaaaacataatgaaggctggagaagccaggccagatgagctccattgtgaacagacaccatgattataatgtccagccccgtgtcgttctgtgatgaggctgttctcagcttctggccaagagcccttacttgcccttgctctgcaatgtgaggacagggagttatttcaaatatgaaactgtgcagacgtgttcccaggtcctttgccctttaccagtgagggtgtttaactaagccactttttcggtaacgtgtattacaagggattttcattttaatatcagtgcagtgtgggatactgctatgcagcatcctatgtgtgtttcaaagttatgttcaaagtacaaatctggaagcactctctcctcaaaacatatcccaaactttactgatacatttagaaaacgttgacctcttctgtaaatacttaatttgaccataatccacttagagcagagaacatggtaatattttcacctgtcttcacttatccaaagcaccaaagcactgctttttatggaattctggtacatttcactatcaacttgcttttgctctgccaacaaattacaattctgaagtacattgtacttcatctgtacaattaagaatctgtccatgtaaatctcctgcagcccaataattcaggtcagccatcagtctccttgaaatgttctttcgcaatcgtgcgaaccaattatcttttaattttgcagacattacttgagtgaatgctaggtgcttaatacacaaagatgagaagaaagagctttctgaactctaggtttaaggtaggaggtaggcccataagcagctaccagtgaaagacaaaacatgtcatgaatacagaaatagggcttcaaagaaagaccgcatcagtgaaaaagaaggacggattaatcccaagtggagaggaaaagggaggctacttcagtgctaagtaaaacagaactacaagcgtataatacagcccattatggtgagaagttccatataatgtggaccatgttgaattccattcagttcatcactaaaacacaaaaaggatgttttcataacccttgttcacagtggcctggactttaggagaattattatgagataccaagggtgtctttccttgttaccattagacaactatgtctaactacttgcatttagaaggctgcacattgtctgtatgatgtttctaaaaaccaatagtaaatatttcttattaatgattttgatttaatcacaagagttaagcatctaggtaatgcttctcatcggtctacaccctcgccaaattcactttttcttcttttccctgactcctattgctctccatccttctcagctactattttatttttcctactcaccttcgaacttgagcaccccagctgtgcatttcctctcgctgagagcacctccagttaaaggtgctgtgggctcttactgagtgaggcctttgggttgaaatgatgacccatgcaccctgtatttgtattcttagtagttccttgtaatttaattgttgctgtacaagggctatctccagaaaacatcctggggctggcatttttattgttggcctccctgcttccagacactagtgttttgcagttggttttggtaaagacagcagtctatcacctcagagaacatggcctttcattctccggaaatagttttgatttctatgttctggggaaaaggtaaatccaacacaaaggtttcagtaggaagaaagtaagtgctgagggaaagagggagtattactaagagatgttaaggagcaaaggatttcagaaaagtagcttgccatggcacaaaggtatctgcagttcggcattttgtacatggctaataaagggttctctcaaatcaagaatctgacaggagaggccgggtgcggtggctcacacctgtaatcctagcactttgggaggccaaggtgggcggatcacgaggtcaggagatcgagaccatcctggctaacatggtgaaaccccgtctctactaaaaatacaaaaaaaattagccgggggtggtggcgggcgcctgtagtcccaactacttgggaggctgaggcaggagaatcgcttgaacctgggaggcggagcttgcagtgagccgagatcccgccactgcactccagcctgggtgacagagcgagactctgtctcaaaaaaaaaaaaaagaatctgacaggagggcggtcaggatgccaaggattgggtacccaatttcacaccacttctgaatggcaagttttaatgtagacacactgcaataaattcagtttgacaaaccactgtagattatctaccaggtgcaagatggaacctttttttaaactagtggtaacatttgctggttgaccatttctatttgatcacaagagtttagccaggtcctagagagagaagagatttctaagactcagaactataaaggtgacattgtagtggcagtgggtcaaggcttgcaaggggcagactcatctccgtaactgtgcaaagcactgccataaaaggacagcgccagaggtgagggtggtaaaggggaatcgatgaaaggtcaggcattgccccagaaagacgtttgtttcttagccctgcagggccctgaaatgttcattaatgatacaaagtattttcaactcactcatggagggaaattgcagctgcagagtttaaaggaataggtgcctgtctattaaatatccggagtgcattagtcgaatcacccaataacaagcgaacccacataaggtacagactctgtgcctctgggagaataagttcaaatatatttacagactctacagacagaatattttgattgtcaaaattaaggacaacatttctagtaacatgtcagtgttgcgtgagcaaccatctatcaggatcaaaaatggaaataaggagatttgaattatagaaaaatattatagggatccccagtggatgtttttagagtgattaggtgggatcaattttatatggttgaaattgatcacatttttcaattgctagaaacagcaaaaatgtttataagctgagtatgttttactgtatagacaagtaacctagttagatgaatataatataatgttattttatgtaaaattttagaaagaaagaaagaaaatgggactctagcagtgtcgtcaacctatattctctcttcctgagtactttactaattttagagcatggcgacctcctaaactctaaattgcctgcaagtgcccacatttttttttaaatctataaccttatccaggagttcaggagccgcattttgcttttaatgatgccctggtttttcttgaacttctagatcctttgaagtgcaaggttatagagtgagtcactggttgggcctgagatcccagcagccctaaccttataaaatgtgatcccgtgtcaagtaatcaactccaatatttctaaaagcctcctcctttggtacgcatttacgcaagaaggcacaagcttctgttggcaccagttagtgtgggtcaacctgcaggacttcaaataagctaaagataaaaatcagtgagtgatgtcacatttgaccatgcttttgtggcagagtgtcttgcttctcttgaatggaaatgtgtttattattttaaacatgctttgaaatggattgttacaaaactgatcaattccggaagagactgttcccagagaggatctgggttcatggtgctatgcaggcagattaaggggtaggttatgagaaatcattgttattttctgagtactaacaggacatttatctgctctgcaaatgagcccaaagctcccctcatttggaaaaccaaaaggtaacttgaactttactaacctaaagcaggaatgtgcatccaggaacccagtgacactcagacttgagatagactcaaagtttcaatagatgccccagcactaatgcataaagccaccctgaatgtgggaagcccacattgttaatgcatgagtagcacacatgcaccctagagctttcgttaccaagtgtggctaagatggcattagaagcctgtactctgaaactctttagttctgtgctttgtgttttctttctttctttctctttgtctttctttctctttctttttcttttcttttcttttcttttccttccttccttgcttttctctccttccctccctccttccctccctccctccttccctaccttccttctttccttctatccttccttccttctctctccttccctccctccctccctccttcactccctccctccctccctccttccctaccttccttccttcctttccccttctctctccttttttctctctctccctctctctttctcttcctctctctttctttctgtcttggtttcttaatgaaattattctcttaaaacatcaaacttgttatggcaaactgaatagaaaaggctctctgcatctgacagcgggaagcaaaagagcatgggggtgagggggagtcgagggctaccagtggaggggagccagggagtgggtagtcaggaggggattgtgggtctcagccgggccctggagctctgccttgcctgggtgtcctattttgtctgtgtctgtgcatgcagttttttcagattaccagtatatatggccttctttttttaatatatgtctgccacagttttcaaattagctttcatctgagcattgtgatgattggaagtcctatttgggatcttataaaaacataaatgcaggtttatagcccttgcaaaaatagctactttatgagactatttcaattccacagaaaggcagggactgttgagggagaggctgcaaataaaaccttttgatggatggtaatataaggtcaaaatctgccaccctcagaaagtttttttgtggatatctgcaagtgactgcccagtagaagtattaacctaagcgtcttccattttacgtaactagaacttcagatatgaaaatgtagccatgtggctataaacaagatttctcttttttaaagaagcatttgagtgtgcaaaatgtgaggcagttcagcctctcaagctttgcacagctgcagtgcctggggccatggtgggcactctcccacgccatgctgtgtcatgctctgccttgctgatgtgcaccttcatgccaggcacaaccccaggatgcaagctgtggtctataaacagaacacaggaactgggcaagaccaagctgggagcctcctcatccaaccagaggtgccatttcccaaaactcgatctaaccatgtactaatccacaggctactaatgcttcccattgtttcgctcctctttcttctccatagtacttcactatacaccatcctgccttagtctctcaatagccatgcaaaatggttgagtatgaactgcccattatgatgccccaattttctttcttttctttttcttttttttttttttctgagacagagttttgctctttttgcccaggctggagtgcaatggtatgatctcagctcaccacaacctccacctcctgggttcaagcgactctcctgcctcagcctcccaagtagctgggattgtgggcatgcaccaccatgcccggctaattttgtatttttagtagagacggggtttctccaagttggtcaggctggtctcgaactcacaacctcaggtgatccgcctgcctcagcctcccaaagtgctgggattataggcatgagccactgcgtccagccatcataccccattttctgacgtgaaaactgaaggccagctatagaattatccagaatcacatatgagtccaggcagagctagaagagagttcagatcaatctccctaccctactcctcttgccatgaaacttctgcaggattttgaatattcaagtaagaaacaggttgtctcatcaatattaagtaagctctaaaggtttatcaattatacctggaattagaagatgtattaacacagtatcaatagctactatataattttatgtttgcccatcaaaaatacttggtctattgattttgtatttcgatattcactacccttcagccttcccctaattatattttaaatatgtatatattatatacagagagaggcacatatacatattccttctagcttgcatatcttcatcctactgtctctctgattcttttctccactgaatacttgagagtattctgtcctcagctacactacctctcaattactcccaaattcccacagtccccttccactcgccacccaaatgtaactgttctcctgaagacagatgaccagttattctctgatctccaaattatcctttcagccatcattttttagccctctttgcagcattcagagtgttagcaaatgttgtcttttgaaattccttccttccacattttaatatcactagattatcctggtatcatttctccatcatttcccagcccaacagataagggaggagcccagagccaaggatggaagtgtgggagtagcaagcggctttagaaaagatgtcgcgaagtctgaatctcaggctgatctgaaatgtgtgggaaaaaatgtgacaggcaatgcaagggctgtttagctgtgtttgggcaagaagaacaaggctgtgaacaatgttctcatattaacagatggcaggtagacaggagagctgctcagcatctgctttgcttgatgtgtaccaggagaaatgctatttgaatcagaaaacgtggaccaggaattataaaaagaaggaaggaaggaagggagggagggagggagggagggagggagggaatgaggggagggagggaatgaggggaggggaggggaggggaagggagaaactcaggatgcttatgaaaataatcagcaccctgatagtttaaaaggatttattttttttcaaaacatactctgtattagccattatgtggaggtggagatgttgctttttgcagacaatgtttacaaagaactattacacaagttccaaagcgtaagcagcctaatgcagacagaataaatgctgtgctgtttcactgaaaggaaagatctccaccacttaaaaaattagggaagctgtcatggggttccagtcccatgattctgaaggataacattttagggttctgaacaaaatttttccagacataaccccaagatctttctggataacctttgaacaatcaaatgtaaattagaggtgttagaaaatgattatgcagatggtccctgacttactatggttcaacttaggagtttttgactttgcaatggtgcaaaaatgatatgcattcagtagaaactgtattttgaattttgatctttgtctgggttagtgatatgtgatccattatttttacatgagatactcaacaccttattataaaataagctctgtgttagatagttttgcccaactgtagggtagggtaaatgttctgagcacgttgaagataggctaggctaagccctgatgtttggtaggtcaggcatattaaatgcatttttgacttaattatattttcaattgatgatgggttcatcaggaggtaatcgtaagtcaaagagcatctagaccctggacccattttcaacaacaatagattaattctggacattatagactgaaataagttagttgaggttatagaaaggatgttttgtgagcaatcagggaagggaagggaccaccaggggcccagacaaactccatttgcattttgacagggctgattaataagggtacaccaggatgtagctgaaagcatgggcaggctaatccaatcttggaggccacatacatcctggtggggaagctaatgtattagagggacaaatccacattttaagagattttgaaaggctggaagcaagaagatacagtttaataggaataattgtgaagtcttctatagaagttgtaaaaaaaaattcatttgcaacacgtataatgagcattgtgctctccctagtgtgctagaagatcaagaattaccagcgtctttctcagcctcattttatagagaaataaaaaaatcacaaacctttcaaagaagagattcccaagtagggaattacctagaaatcattccgtatgaggagtggctgagaaaattagagaatgtaacccagaaaagagaaagctgaggccaagcaagggaaatgcagctacatggaaatatctgaacagctggcaaatgacttcaggttaaaattacatcaaggaatttctgcacaagaaaaggaagatgtctctcacaattaaatgtgtcctcaggaaatctttgtgcagcttcactatggatcagggacaggactgtgcccaaaagggccaagagaaagacaacccgaaaacaggtgggcacagtatgagctgggaagggctgtctgagatataaggcagaggtccagggaagcggagggaaccgaagcttcacccctgcctactgggcatgggagggtacacggagcaagttgcgtctgcatggggcggtggggacgatggagggctttgcactagcaaagtcttgggctctctgcagaaagtggcaagtgcaggaaactcagagagaggttggaggttacaagtgagcggcagcggagccggatgacagcttggaccagcacggaaggtgggttctctgtgctaatgagggctgttgcagtgaggtccctttgaaggtttcaaagcacaggtatcactcagtaagatggattccagtcttcacccttcctgcagtgtgggtatcagtgttgggcacaccagcagtaaggatgctgactaataagtgagattaggactgagaagagaaaaaacaaaggttcccctggggacatgctggctgggagagacctgcagacctggaaggcaggagagtactgggaggagaggaaggacactaggtgtgcagcaggagcaccgaccccaaccgtggagtggcagtggccccagctctggattcatgcagacagagaatatgtgtacgtctgtgtaagacattgtgaaagggattccaacattcattaggtggccaatctgaaaagtctttattgctcttaagattctgtgattccgggactttaaatttttttcttggcttgtctcagactctcttctcaccctcaacaaaagtgtgtcccagatgagattttgccatcttctttttgcactctctctatggggatatgaaaaacacccagaccctcatctcagccctggcatctttccaaatttgattccaaatttgcctctgaacagcctcacctaatgtcccccgatattgaaactagacaagtctctcccaagattgctgcttccatgttgttctagtccattcctgtcactcatgttactacatccagctctgcatatcccaaatcttgcccttttcctggactccctgcaactcctccttgtcccactgtacacctggtaggactctgattcgtacagatttcctctatcttcacattataatgttacccacataaccctggctctcttctctaatgcccagagcctctcacttggactaaggactaagaagctttcaacaagtcccaggcccccacctccacattcagagcattctggattgcctggtggatgctagttcacagcacccacacccatccaccacccacctctgccctcctttttcctctctccctttggcccaggtagaagctttcaggtcagtaatacaaagtcacatctccttagctctttaatgtctagactgtgcaccagaccaccatcctggcaacttctctgtccagtcaaattgacctagactttacttctcaaatgggctcataattccgatgcatgtgaattctctgcatggagcacactgcccattcatggcaaagctccccacgtcccatgctcctttaaggtggggtcagtgttaggtttagggaagggttgacccaaacggtcaacccttggcatctagacctgtgaaagaccttagccttggggaggatgcctgcacgtggcagccaagagaggtctgctgtcggcatggcagtcattgtggggagctcttttctccctgctggactccgcaattccttagtacattgccatgaacagctcataggagagagctgtgatgactgaccgagaataggaaaaggagagattattgtggcgggcagaatgaggaaagcagttgatcagaagacaattgaggctgagaactctttcaagtgtgaactgaagtgggatgtttactccttgaatttgtttccccctttttagagtattgtaccagccactgcttggtagttcattggagctaattaagtccaggcttctggcattatatgtatgtgtatatatatgtgtgtgtgtgtatgtatatatatatacatacatgaagtatatataagcacatatatatatatatatactttgtaagtgttaaatcattcagggaaagaggaaattcattatatttactgtgtctttgcagataaatataaagacatgaactgggaaatccaatcctattttgatttcttttctttgctgtgtgggtggagtatatgggccctgtttcattgcccaggctgaacccatctgtgcacaaaaccaggccccatcttggggttaccattgggactggccaacttaacgaactaagcttggctcatggcaaggacagcctctacgtggtcattctgtgactgtccacgtctttcagaaatagcatgctgcccactgtgcagaaactgactacgtttaattgtcagcccccaaaggcatgagatggaaatgctcccacatacgtatactttcactgcagagctggtcacactgtcagctgagtccatttccggaaagttctgttcattgaacagtatacttagcatcaagactttttagagagcaatgaaataaaaacaaaaagaaggtttttgtgctctaagtaaggaaacattcatttttgccaggaccaaatgtgtaaaaagaataaattatattttaaaggaaacgggaatttcaaaataacaccaccaaaaaaagggattttttttttcctacacttttagtcaggattccttctgtcaagagtggtaacccggtcttggtaaacaatgtgctcagagaaaaaaaaaataaagtttttttaatttctgaattcaaaataaacatctaagtttccaggaacatttatatttcatttatacgattctttggtcaacccaaggaactcagagctctgtaataatgccacttacttctgatattttgataacaaaaagcatgggtttgttcaacgtaaatgatataccctcaaaatgttaattttctgactactgaaaataaaattggatttcctagaagtgactgtaggttggaataaaacatttagtagatgtctgagaatgttataatcataggatagttatgttgatatttttgtaattaataaaatacattttaaaagtcccatttagaagaaataaggactccatgaaactctaggtcattagtagtgagctgggtatatgattgtgtttcaaaatgactgttctgatctgactgtagagtatttgtcataaatgcctaagtgaatgttaatgagttatttaccatgtactaatgttaactttctttccccagatgcaaagagtttagctgaaatgctcatgaggtaagaacaagacctagcaccccagatatcatgtttgaaagaacaatttccaacttgccttgatgatttctatttttttaataatggcagtctgaaattgataatgtcttttctttttagaaaaaactgtaatttcctatacattccaaaatatccatgtaatgcctagctgaaggtgtagatgaaaatgatgtatttgtagacatgccacaggtagttgtcttgttggctggacacaaccaatagaaggcttcccattagcctgggaacagaagcacgtaaagaggaagtagctttagttttgccttcatctaaatttactactggtgaggtcaagccttctttctaacagaataatccaagttaaaagaaaagcacaaaaggaatgtgctatgccccatgctcttcaaaggctctgtgtctccatcagcaccctccaccagggcacccttcagctcctcttaccactgtctgttcactgtctattctggtcctggaagtcacagccttcatagttcatcctcgtgttaggagtagccagcacagtagttgccccattcataaccgtggaggggatgaatgaagagtggttattgaatgagtacgagaatgttcacaactgtggaagacagaaatgcatccttcacagctttcctttcacacgtccacaggcttgtgattggcaaagctgtgacaagtgtgttactttcacgtccccaaactctattttccacccagtccccctcttcaaatgttcagttttcttgtgctgtccaacctttttactctgtaaatactagaacactctgatatgaagcatttacacgtatggattaattgcctgatgtgttacctcaccctgatatttgcattttaggcctttcatattgcaatgattacatgaaaagtgaaaaaggaaaatcagagtctaggaaataagtagggaaaatgtcaaggactccgatagtgaactcaacattgccagtttaggatgatttacgtgggagagagagggtggatctaggacctcttcccactcccatcaccaacacatttgcctgtgacttcctcctccatctatacatataaaattagtactctttgttatttaaaaacttcccatgttccatatcactaatatctttgaagaccgaaggcagtagtagaatgccattggcacacagattccatcctacagacattttgtttggccataccgtatttcaaaacaatgtgaatcgtaggtaaaacaatgatatgaaggataagtcttttcctttttcttttttttttttttttgggacagagttttgctcttgtcgcccaggctggagtgcaatggtgcggtcttggctcactgcaacctccgcctcagaggttcaagcgattttcctgcctcagcctcccgaggagccacgattacaggcgcccgccaccatgcctggctgatttttgtatttttagtagagacagagtttcaccatgttggccaggctggtctcgaactcctgacctgaggcaattctcccgcctcagcctcccaaaatgctgggattacaggcatgagccaccacggaaggataactctaaaatacatttgttgtgactgatctgatgaatgttggtgccatctgccaagattaggaagatagaggcaggctatggacttttgatttttttggaaggtaggttgggaggaggtattgatgggaatgaaaagacctatttgggtcatgttgaatttgggattatttttaaggcatccagaggaaatgtcagatagacaactggtagcagaaatctggagctcagaggaaaagcaaagatgcaaattccctgtacagtatctccttcataaggggtacttcatcacatttccaggagaagattacagaaattgcatgagatgccttcagcccgtgctttttgtttatgtgacatttatgggtcacagggaacacatccaaacacacatgcacttgtgttaagcagatctgataaaacaaagatctgcttaacacaaagaagctggaaaacaaagaagtcagagtcacatgacttgtaataactgatctacctaataaaagaaattgtcaaaggtagactttaaaaatatgaattagttgatgacatttaaaatgaggagatttcacataaaatttggctttctgatttctcttgaaaatgccctggccatactagcaccgcggaggtgataatggtgcctggaggtaggcacagtagccctttagaatggcgtgagtttgctcaccaccgcagcccccacccctaccccaccccgggcctgcttcaccagtccgtacactgagcagggctccttcagccctccagagagcttctcctcccctcaactgtgctctgcacaacctaccctggccccctcccctatctactcccaaactgtaaatcatgcctttgtccagaggctgtgaaactgcgggctatattttctgacatgttcaacatttgctcaattaggatgatttgctttttctcttctcctcatattctagagtacattcctactccttctccctagcctctgagaaagacattagcaagcatcctctatgaatagggcagttgctgtggttgcaagaccatctgttgataagaggaggaattaattatggtcttcctattgccagttaccagcatgaattaggaagagtaaagccagtaatcacaaccacttatgatagttacagtggttttccttcaaatggtcaaagtgattgaaaaggaagagaattttcaagctcctccaataggtggatttgtatgggattaatttagaagtaaaagcaaagcttttacccatgaaaggttggttcaatctaagttcggcaggtgaatgggccaagcaaacaaaaacctcattacctaactggtcaatttagaatcaaccatatttggacatggcccagggggtccagacaaatcatgtccactggcagagagaaagatactgaacagctacccctggtctgtgttgctgttttctctagaagtcaaaggaactggcagcctggtacagtgagaatacgaaccacaagtctgtgctctaggccccatgtggccataagctggttttcagatcttagtaggtcattttaccgctttgttttccttacctaaaaaataaaaataaaataaaaaattcaacattgtttctagctttatcactccacattctgtgttctaaatggatgtaacatttatttttcaaccattttctaccaagaagtatctgcgtatttcagggagattagctgagggccaggccaggaaggcagattggacagcagaacatacccactcagtctaggtccccagggattcctggcctggcagcatcacccattgctgggcttcatgctcctagatatccacctgtttcacccatgcacatcaccccagagaagagagactgcatccctcacacccagacagaaagattgtccttttatatttttatgtaagatttttatttttaaaaaacagccttctaagaggtgtttgctccaaagagataactgtatactgtagagagctaacatataatgtttaaggtccaggaatcagcattagcgagtgagttgggtgtaagcagaaaaaggttcaaattagttcagcttttttgatgttcatatttttgtgcacataataaaaaatctctaccctagtgttataatgagctatgctcctaatagtccaatagtcattgtacatttaaggaatgttctgtgtcatatttgggaggatgatggactattaagactttgaagagtggcagtggctgcaaataattgattggctaagctgggaaattctctgccctatgaaaccgtctctgctctcctcttcttctcattttattcaaacaaccagatggcaaataaatggatggttgaagattatagctcaataataactaatatgtttagcatgatcctatgccatgcaaaaaagatgcaatttttgcttccacagtgaaaacatttggactgtttttccaggttgcaaatgaggtttgttcaaatcacttttttaaggtttgctgccattctaatgaccaattgttatcatttttgaggttaacagaacacagagtgataaatataaatgtaacaatagattgtcaaaagtgacagcaaatattaagtaatgaaataacttagttggaatccagtgaccttttagaatgagaaggatattattgcctcaaaacaaagtcttggggacatctcactcagctcacgttgtgccctcaaaataaatcaatgtgaggatttacttcacagatatttattgagcacctactttggccatatactgttctaagttctagggagacacaggaaacagagcaggtgaagaaaaccctggtggagcatattttccagtgagagaggcagataatggataagataaatcaactaagtatatgctagagagtaataagtgccaagcagacaaaattaaacagagaatggggacaggacacagaagacgtccccatcgcagggccagcctggctccactggaaagatgatggcatctgagtccagccttgcaacaagggagccagtatgtgggttttgggggtagcaggggaagtgtgttctaaacaacgggaacagccaagtgcaaagagaaagaagaactgtgagtccggccaggcgcagtggctcacacctgtaatcccagcactttgggaggctgaggcgggtggatcacgaggtcaggagattgagaccattctggctaacagggcgaaacccggtctctactaaaaatacaaaaaagccagacatggtggtgggcacctgtagtcccagctactcgggaggctgaggaaggagaatggtgtgaacctgggaggcggagcttgcagtgagctgagatcgcgccactgcactccagcctgggcaacagagcaagagtccatctcaaaaaaaaaaaaaaaaaaaagactgcagtgaactgtgattgcatcactgcactccagcctgggcgacagagcaagaccctgtctctaaaaacaattagcttctgaatctcaaggcttgttgggccgttttcttatagtcttctgaggaggaagaatttacctccagccttggttgtcctggttcgcagagttgaatcaagttctaaatcttggtgccagccagtcgcagtggttcacagccattatttagcctgcttcctgtggcaatctggtagcagaccccttattgttgtttaagtatagcctgcacttggtgttcatcgctatttaatagagcagccgctgactgcctcataactattcatgaagagcagaaggaactagctcacacttctatttttggtgcaaggacaagctcaagtccctagtgaggtttctaaacagatctttgggatattcacagaggagtagttccccatatgtttttgtggaaatatagcttgtctaagcatgccgtaaatgcagccccccaagtaaccaaaatgctcctccttttatttgattatttgaattttttcattactctctttttaacaaaatcaacgaatgacaagttagttaagtcagtaatttgaaagagcttggagaccatgtgaaaagtcaggacaaaacgtttgaatttgggctctgcataattagcatgatgtaggtacatagcccagttccttatctgcagagcaagcaatctggttcaagatcaagtcctaagtaggaatgttgcacctttcagaagttgtctttttcatgggataatttgcttttactcaaacgaggagtatacatggatctcatcaggcaaacatctaagggggtacttgagtgaccttcactttgggataattaaagttctgtccaccacttggtttaagagtggatgagtcctcattaacaaggaaggatcggtggaggcacagccctgggactcggggtaaatggctcggttagaggggaaagcatttaaaatgtagcattgagtattcctattttggtctccactaaaagtaacacagaggtaaaccattattgagttaactaggctccagaaatctttctcaaaaccagtgttaacaacaattgagctggattgatggatgccatagattatgccattgattggattatccaagtgactgctgcttcttagaggatgcttcagtaaatactatttgaacatctagtaaagtcttattattctgtaaagactgaacaaccacccttctaatgtggattgctaattaaagtctttattgacttttttagatttttgtgcaacgtggagttttttttttaactgcaggctataactgaatccgattctaccatgcagttttactacttattttcatttacttttagagaacagctcactctaagagtaatcttctgatacacaaattttgagattaaattatgatagtaattgctttttttccattctaaaatgtactatcagttaggaaaactaacgtcagggaagctaacaaggtttgtgatttgcttctagaacaaaaataaaatgacaccagatataaatacaaatccattagtaaaactcccatccgacaaacagctggtgcacgtgctttttccctcaccatctttggaatatctggtgctttattcctcaccatcactggaatatctcacatctgacaaatgaaaatgctgttggtttttaattgcttttcatttgtttcatttagcatttacacaagaaatgagaactttctaaagattctattggtagatatagagccaatctctattgacaatttgtattttctgaaactctccagccagctgaaatttaatattaataaataaataacatttgaatgaaggaaacgttttcatagtatgtacgttttctgttcccctcctcacaaggtatttgtatatttagacaataaactaagttggtatacaggtgcatgttggtagaatgttaacactgaactggatttgttaatgcattaccccattttattcccagtaagaatacccggacttcagatacgttaagcaagcaacagcagaccctgcgaatgcacatcgacatacccagggctcagcttttgattgaagagagagacacgatggagaccattggtaagctgccctatttgccactttacacaaagtggctgccacagccatgccttctcaatccaaaccccaggatgtgggaaatattagacaggagagcgtcttgaaggctacgtgagtaccaaagctagaaggtagagaattgttcttgtgaagaagaatcagtaccagcaaatgtgcagaaaatttgacttatatataccaccatatatgccaatatgccagtcagttccaggcatttgggacagaaatccctcagctctgatccatttgggatctttccaggggaggctacggatgccactccaaggaataaacatctgtaatcgactacacatcaatccagaaggcctgcactctaaagccccaggttgaaaatccactccgtgcccccctcatcaactctgataatgcaagccttcattaaataaaacttttaaactgtacttaacacttaaacaaacacatgtctttgtacagggtatcttcccccacaccagtgccccagaaacatcctgcagctgtttccccagcagcactttgggaaaaacaccagggccctagttttagggtttcagaacagccaccctgaggttttctggcttgttcaaccagaacccaggtatcttcactcttcccagcctctttccacctgaagtccattaccccacactgcctgcctcgattattctatttattccggagtgaaataccttatatttcctttccagtaataatgagaagaatagctaacatgtattgagaattctgtaaatgtcacatagtttttataagcacttcgtgtgcattacttaatttaacctttcaaccaacatatgaaagaagtcttgcttttgtaaccaagatgtagagaggtctgtgtagctttccaaggtcacagagacaggcgcagaaccaggttccccacctggccacactcaccgccatgctgtctgtctccaatgacagctagcacagcagcaggccacctgcttccacaccaacaggctgcttccaagaaaccctcaaccagaagttatccaagcttttgagtgcccatggaaacaccctgaggcaggctccgaggctgcctcttttcaaacctggctatgtttgttttggaaggtgtttgctggcatgagtcccaggacaaccctttcttgtggtctggataaactgcctgactctcagcacatagcccagctgcctcctgccgggaaggcagtggtaagagaccaggtgggcagaacacctgctccatcaaccatcacccttctgctgccccacccaccactggagacatcttgacctaatggctcctaaattctaaggcctgggttctcctggctgaagtcacatttggtccaggcatagcagcacttaaagattggtcaagtgcaaagtggctcttgatcagctaacttcagtgaaacacttcagttaaaccatgtatgtgaggtggcactacctgccctaaagtacacaagattttattagcttgcttgtatcaggacaagggataagctactatgttttgcttttgattatctttttttgggaaaggggaaggtatacctggaatctcttttgtttcacccagtagattgggcattaaaactgaaaatttcctttgaaaaaatttcaaaaattagaatgtaattcctttgaccatataattttataagccatttatatgcattatttaatttaacccttccagccaacataggaaaagtttcttttgtaactgagacacagagaggttacatagtttgtggaggtcaccatggttatataacacgttacaatatttgctaaatgcgtctcactagacaataatcctacatatggctatgaaaatagatagctaggcagatgccatgagtggtctatggccttccaagagctggtcactggggggcttaacaccagaggaagcctgccagtcatttccatttgtaaatatgaccgttcgccagagatccatcccagtccatgcaggatcatgtatcagcaagagcccttgacctccttgtgatgcctgacaatgggtcgatggcattttctaattactgggaagtggaactgtggtgcttcaaaatgctctgggctctgaccacaagaatccaatattacagtgacattaatttccagctagaatgaatggttaacctcatgatcagacaggcgcccaaaattttccatgaaaagtgtgtaacctagccccgcagatcatctggtgtgatctaaaagggcctgcctgctagaaactgtgacatatcccatcattaatgaaaaacaaatgtagacacggagcctctcgtgctgggtccagttgtaggaagctgtctctgtggaagagccaccctctttgaggagtcgagtgaccgccacggggccggacctccaagccaagcccaggcgcctgctgtggtgccaacctcaccgcaccatgcgctgggatactcacagacatcttggcagcctttcctctatttctctgccaggaaattttattctaactttgagaggctttcctttcctgccagagactgagtaattggattttgtaaggttcattctgttcagagccttttttgggcacagaagtcgagctgtgttgtttacgactttcgcatccctgttgcagtgtcagggcagggctgcagtatggtccctgctgactgataaactcttagcaacagcatcctgggctgcaatctttgaaaatttatgaaaaatctgtatatcctagccaaagtctcccttggagtaaaaaagctttttaaaaagtatgaaacatatcacaaggtagtaatgagaatcctggcccaccaaataatgacccagctcaaacagcagctcctgctccaagcactaagatgcccagaacccatccaaacccaggctcctgcctcgctcaccttcaagtgcccacggcagtaggacttgggaagtctgacaagtgaatcatgtaggagaagtcagttaatggatgttctagagtgcttaaagcttacaggaggtgggaagaaaaggaacataccttgagtcctttaaaatagagcaatcaataagctctgaagactggcatgttttcttctcttttatttcccctccaaacattagccaagttcagaatgagagcaaacctcagtagagagaactgtagtggcgattttctagtcctgcaaacagagcttcccagcagccaaagggacctgtcttcattgacagcctcatcactggtgagggggctggcatcgcagatgatgtctcagagaagcttttgacaaacacataaatccagagttcaaatcaatgttagcttaatgaaaagccaagcccaaagagaaaagagagctccttctctgcatagtcatggttcttcttagctcattgctcccaaagccaacccctaggaagaagcttctattcctagcactctagagtaatgctaattcagtgcttgaattttcaatcatttttgtcactttagatggggctattattgtggttgtcattaacaataacacaagtgcctcaggagagaaaaggccagggagtggttggaagggagataaacgtgtttggctttctgtgttcctgccatcctgtagatgatcgctccacggttctgttgacggatgctgactttggagaggcagctaagcagaagtccctgacggtcactcacacggtccattaccaatcggtgtctcaggccactgggcccttagtggatgtttcagacgctcggccgggaacgagtgagtggtcaacaatgcttaaaatgtgtgggtgttaacaatgctgaaaacatagtaatgttctttctctctcaaatgaaaatgtgtggcttttcatacctatgcctgagaaacaaatgggtataataacatccctaattgggataatgagctgttattgatggatcttggctattattatgtcagttgaattactgttagtattggttactataaaaagtgctagaaatttcaggtacatgtatttatttttttaatttaagcaacacagaaaaggaaaaaagtaatctactttagtgtgtatctgctgtatgccagtattgggatagaacgatgatgtcatgcacgttatctttgcaacaatcctgtaagatacctactcgtgaagcaggtatcatagcctctattctgcagatgagaaaactgcagcctcagataaattatgcaaacagtataaagttgcacacataagtagtaaaaccaagattcagaaacagacccatctatccccaaagcttatgcttttgcccctgaacacactgtttgagaaaaattataattctagttaatgtgaagattatgttggattttgttattaatatttgcatccataatatatggaaattaattactgcaatgaaggtgaatcccctaatatgtatctagagcttattaattagatactcttatttcttcataattggaatcgttcctaaatctctttaaagactgagaaattgatgtcctgattattatcattttggaaactttgacgtctagctttcaaatctctaatcaatttctttgcaaaaatttacattcttagaatagtgtgttattattagaaaaataactattataatgttaaaagctattcttcataaatcctagcttgggaagcatttgcgaaatgcagtgagctttatgaagtaaacccattgcctacgaaataacattgtaatatacagaaaacagtttcagcaggcattgaaattcatttaaaaaatgttttcaagaatattctacattctaaagaagtcttttacctcttccttttgtctaatcttcttaccgcctttcttctttgatcacattaatacattctgaagacataaacgggatatgagtgggaattagctttgcaaaggggtgtgtgccagagccttgctcttaaaaaatgatccagactgggcgcagtggctcaatcccagcactttgggaggccgaggcggtcggatcacgaggtcaggagattgagaccatcctggctaacatggtgaaacctcgtctctactaaaaataagaaaaattagccggcctggtggcgggcacctgtagtcccagctactcagaaggccgaggcaggagaatggcgtgaacctgggaggcagagcttgcagtgagctgagatcacgccactgcactccagcctggacgacagagcgagactctgtctccaaaaaaaaaaaagattcaagggctttgacatctcttcagccgttggcttctcccttgtgaactgcctggtgtggcttgctgctactccaagacactgctccaatgggtttaagagccacttttttgctgctaaatcagaaaaagttacagatattgaaaggattagatttttagagtgatgcagcattggcttcagcattctgttggaaacggtggcagaagagcaggcaaaagagacaacagagcagatgccctgggtctcgttctccacctttacatgcatcagaatcacctggtgcctatttaaatatcaattccaggcctccacccagagattctggcctaggaatccgcatggtaacagacaccctgggtgattctgatgctggccgtttggaccccacattgagaaacactgccccaagggttagaaatgtttcctgcatgtaacgcagcagggcaggacccctccggcacatcagttcttcctgccaggtaaaaagcaacatgcatttctgcttccctgtcaatggtcagctagcagccgagaatgcataaagctagtcataaatagttaagacaggagaagcagcagcccaaaacaaaagcactggcaaccttccagcttcatggtcagccccagaataatggggaagttgatttgttggcatgtaaaatatcaacagagacatgaaccggagtcacagcagatactgtaaaccagtggtcagcgagtgccaggcaggacgcacatgggagggacgtgtgtgtatctcatggctataaagttggaagcagggctgggaatgttaatgcgttcattcagcactcaaaagtatttattcaggtttcactttacgtatatggctcagtgctgtatgatggagatacaccatgagtaagatgcaaaaagacattcatttcatcctagtcagggggcagacattagacatggaactaaagtagttttcatttctcagtaagtcctagacagaaagagaatgaagccatggtgagtcagcgggcgtgtggagcagtgggaggggctctcttgggtccaagtcattcaggaggacttccagtgaggggaagacatgaaacaagatcagagtcacagcaggagcagagggggcagcagggaaaagctcccaaggttccccgcatgatgaggatggaagtggcactggagcacagtgaaaggcagggaaaaggtgagacagagaaacagctgtcctcatctttcagggtcccctaagccagtgcctggcaggtgcatttcattctgagagtgctgagatgctgtccctggggcttagcctgatgatcacagggaaacactatagcttatagaacaatgtttctgtcctttgtgctgaatttcactaaatgatgtttaccaacatcaagcaaatctactcaaatgcatgcatcagtctctggttcccccctcactctccaaattgagcgtattaatttagcatttgcagaaccctctgtattagtaaaagatctgctggatcatttttttcattaaatcttcctcaaaaaccacagtgtgagggactgacaacactccgtgttttatttagagttagaaatggtaggtgactggccccacagtgggttcaagagtctgaaacccatgaactttctgaagcacagtcccccactagcttcttgcaccagagcttctcacctctgcccaggtgtttatacctctgtgaattccatggagccggttcttctcaccacagtttggcatacttgcagagaatcatttgtattctctattttctcagctagagaacacatcgtgattctattttgtatgttaggactgtgttgtcattgcaagaattctttatttttaagaaaagcatctaaaacatgttgcttgcataccagaatgactgcattgtagaagttatgtttctaggcattttattagtttgccagagggttgcaacagattcttatgaggatggaagaaatcataacaatttgctatttatctctgtcagtagtgaaaacacatcccttggctggttctgctgcactgattacttctctgtctttcctgtggattataatacactggaaaactaggactctatccatgtcctcatccccataccagccacagtgtctgacacaggcatgtagtggataaataccaatcagccatcaagttctgagatcagaacaatgggaatggaaaagaaaagacattgagtcatgtttgctgcataggaatcatgggcacggccagctgtgcctgtgccatgtgcccggagcacttgggcacattaatctcatttaaacttcaggacagctcttaacgtgggtgatgacatcacctagtctcagagactaggggattagtcaggtctgtctgacaaggtcacttggccagcgacacagccagggagtagtgaatatgaacttccagcccaggcagcctaattccaaagctctcactctcagtcattctacatggcctttaggtagagatactacatatagaatatgtagagactaaagaatagacttcacatgtacgcacattcaatgacaagagcttacaacatggacttgaatctttattgctgagactttgaaagaaaaaatgccctctgttacccaggatgggactagcagtggccctgagggaaatacctggggtgggtgaggtgcatccagtggtccaggatgtaataagtgctagataaatattttttagttacatgagggagtgttcagatctcccagtttcatcctctctctgagacaactagtaaattcgttatgtaaagctggacctccacaactgcaagatatggaaaccaatggcacagatgaaagcagattaataccatgatcacagtacgcatgacatgttctgtaacctattatattatctacaaaatcctctctcatcccaaactcaggataattaaaataatctgattcaatgggcagaagcttaattagggttcaaaccccatgttgaaaggccatgagctatttatatcctgtgccctccaactcatgggctgctgagcaggcatgaagcttaatcaccgagttttatttatattagaatgctgggagcctaacaaaatactttccatgaaggagcagtaaatcccagcgtttatttgctcagtagatgagctagtaagttacacaaaaaaggcttcctgtggaatccaagtaaaaattatattttagctgctatcttagtcattatcatacagcagagttcagttcaggtacaaaacaatggctccaaaaaccaaattattaaaaaataaatgtgtcaaataccccagtattctacatactgaggcaattttgaccctaggatgcctgcctagcgcagtacagaactgagggctgtggtttaaggaaactaatatcatgacctaaattttcaacattatcaggccaccagtaaaactgtcctcatctagaaaaaaagagattatgaacaaaattaacttgaaaagagaccaggctttgaatcaaggctgcatgtgcgactttcccatggaattttccaagtagggtgatctcaatgaggaaaggggctatgacagtgaagatctttgccccaccattggagagtgagctcaagcagaagaaatgagggtcaaggtttgggggattggaggaaatgactgtatccttgaagtgggactagcaaactataccccccaaccaccccccaacttccatgccagaagtaaacctgctcagaatgagctacaacagttgtagttgcaagaaacttaaagaagaataaaaatgagaattttcaaaacttatgtaagggactgggtaattttctggaaaagactcattagcatttaaataacaagcttcacttatttaagctccacttatcaagtcgatagtgcctggaagacatttagcctcttccccatcataatgtttttctgtctttttgagggcctctttcctagcatttcggtgaagaaacccaattatcattcatacctggttgtgtagagctccaacataactcatttacattctcatcaaggacaaaaaaaatctaatgaagtcttccgtggaattgtgcaagtaagggatgaaatgtgtcttaaaatcaatgccccagagaatatttaccaagattgagtattctgatgatttaggagatcttaaaatctatctctttggctgccatcttaacgcacctctccagcgacacagaatgatagattagattcaaagtcgaattaactagaaacttgcagtgaggaaatctcccgtttaaaaacaaagtcattgcaccttcccagtgttagcctttcacattccaacatggaattataagcaagccaaggtcatgtagacacagcactaggaaacttagacactcaggatttggccatatgtggtcaagtaacaggcgttatctgaactgaaaaggcagaaggtttgggttatagttttatcacgtaacagctatgtcacttctctctgagcttccattgccttcataaagtgaccctaggtctatgaattccttcagaaaactctgtatgtcagggattattgtaggctctatgaatggatccacagagggataccattgcccctgccctggagacactgccaggctcatgaaagcacataaataaatcggtgcaataacattacaggccggccctgtcagttttgctcctttgaaacttcgtgagagcccaacagtgaatacagtctgctgggtttagaagtggccagaccatactgaaatataactgtatcaaactgctctttgagaagcagagaattcaaaggtagaaaagacccatctaggaccttaagctgtctccaggctggagccccagaaaaatcattccaggtaactgaacctctctcattttccacagaattccagaagaggcgatgttgtagcccattctggtacctgacagtctctgctggtggaacatccttcttcttacctcaccaaagggttgagctaagaactccgtccaccccatagacttgctgcctttggttccagatttagagaaaatgaaacccatctggcaccagcttaaccctttgttctccatattaaataacccaagttgtctctgttaaagttaggacaattctattgaagagatgtgctatcataggcaaggccttaaggagagttgggacataaaaatatggtccctctgctttaggagctttcaacttaatgaataaaacagtcatcattaaaacaatgagtagtaatatgagaaacaaaaatacaggcaacatctgtattaatttcctagagctgttttaacgtagtaccaccaaatgggtggcttcacagcacagaaatgtatttgcttgcagctgtagcactccagtctccacctgcatcatcccatggccctctcccctcctgtgtctgtgtcctcttcttaaaaggacaccagtcacagtggattaagggccaaccctattccaatatgaccttgtcttagctaatttcatctgtgatgaccttatttccaaaccagatcacacattctgaggtcctgggggttaggacatgaacatgtcttttggggggacgtgattcacgcataacaacacctaaggatgtagaaaggaggtcatgttagaacacactgggctgagcttccttgttttacagaatatgacgatgcccaggaagtttaaatgatgtgcatcgggtcataacattattttttgtactatcatccatttaattgcagttgcaaacatcgtaaccaaagtacctctctcaagtcattctctagcacagtaattggtttcattttctttataatcttcatcactgtttgaaattttcttgttttgtcctgtaattgttgtcagtctcccctcattccatttctagcttttaatgttagaagggtcataacattattaaaggccaagagcaagactcaaatatgtaacttctgaatccaagtagggtgttcttttccctgcagggctgattaaacacgtaagtatcagatgaaggtttcaagccataaaggaaagggaaagtatcctctgcacaggagaagtcaaggaagttttcctggagggcgtgggcgagtcggcagtgctgggtgggtggcactgacctctacgcttgctctcagctgaccacactcctgcagacaaaggcagacatgattcttggctcttcacagatcccaccaccaggaggaatgccaaggctgggcccacagcgagaaaccgctatgccagccagtggaccctcaaccgaccccaccccaccatctcagcacacaccctcaccacagactggaggctgccaacacccagggctgcaggatcagtagacaaagagagcgacagttacagcgtcagcccctcgcaagacacaggtaggccctgacgctgcctcctccgtccctggggaccagcacggcccccgcaccttgagcttcatgggctccttggggaggggagagagggcttcctccctcttacttatgttcttttgaaggtcactttcaaattgttacgcggtttatctaacagttactaatacaactgcacagcctttactccacacagggcaaaacagagccaaactgcatctattctgcaggtgtcctgaatcttagacccaagcttatttctccatttagttcctaccccactgggagaaatagagacatttttaaattttcacccccgtgattgcagtaattgctgattacactctgagggcgtctgacccattaccatctccaagattaagacacagcacttgaagttacatgatgaggtcatagcaccctctatagggaacacaggctgatccgtttgacaattaaacaggggttggttataaggtaagtcatccagtctatgccatcaaccaccaagttttcacttcagagagaagacaggccctaagaatagcaccgggttgcccaccaccccctcttaaattttgaaaagaaattacatctgaatctaatagctgtaggaaattttaatactcatttttcttttgttcttgatgatatacttcaaaaacagtgttccagaggaggatcatcgccatgtgaatttatttttaaggctgtgatttctcttagaagagtctcagagttccacacagaggagaccctaaaactttttagtgcatttgaaacgcagacatctccctgaccaagatggcgtggcccagctcaaaggcatgtgggcaccagtttttgtcctgatggttttctagtccccataaagggtaatcacaacagaagacgcatcccaggggtcgggggccattctggcttgtggccaatttccgtgcaacatgacatctttatttctaaatatcatcacatcttccttcctgagctgaggccccagaagctgaactgcagctcaaatcattcatgccaattaaagagtctctagggcatagatccatttgcaggttggagcagagagggggctgctgcctggctcctactgttttcactaaaagcaggattttttttaaagggaaggcgttatttatttatggaaatgtcccaagctgggacatctgactacagcaatttggttgcaacaaagcttcccttaaccggatctgctgagacttgtgaagctggcctcagagtgcctaaggcaggagcctccgccaaggagccagaactcctaccaggtcccaccatgatctggaagaaaacagccccaagccaggaagggccatgccgttggttcagacttctgatggtgagtcgtccgtcttgtttttctctttcctggtgtagatcgagcaagaagcagcatggtctccacagaaagtgcctcctccacttacgaagaactggccagggcctacgaacacgccaagatggaagagcaactgaggcacgccaagttcaccatcacggagtgcttcatatcagacacgtcatcggagcagttgacggcagggacaaatgagtacacggacagtctgacctccagcaccccttccgaatcgggaatctgcaggttcactgcatctccccccaaacctcaggatggaggaagagtaatgaatatggcagttccaaaggcacatcggccaggtaggtgagcaaggccacctgggggccgtcgcttagggaagtgcaccttcctggtcctccctcatctgctgtgaaagcccttctcagtgttcagaccaaatgggtgctctgtttatggatggctgcataacaaaccatcccaaagttcactggattaaaactacagcagtcacttactttgtttatgaatctgaaatttgggcgggacctagtgagggtaccatgctgcagaggctctcctggggctggggatccacttccaaagtggctcaccgacctggctgtgttctccctgtgctggcctctccacaaggtgctttagcttcctcacagcatggtggctgggttctagcagcaaatggtccaagatacagtctgtggaaatagccagtttccttaggttgggcctggaaactgacacagctatcatttctgtcatattctattgggcaagcagtcacagagcccaagaaaccctgattccagagaaagaggcccccactgcttgatgagaagactgtcaaaaatgtgagggctgtattttaaaactgccacactgagggcttctgaaaggggagaggtcttactatatagtcagtgtttgggacttggcctcactgaattacacaaggtgatggtaactggctaacattaagtcagccagcagtttggtcttcaacttgaacacctgtgaatcgtccgggttgtgaaagctgcaaattttgaggtcagcaaggcatggcagataatagaatgcagaggctagagaacagggtcaaaggagcgaggcggacatgggccatttcagggttcactactgtctaaaagaaaagactctagcaaggccctgccaactgatcgcaagtggaaatggggtcttagtatggacttgtgttttaagagaagccggaaaacttggttttatatggaaattcacagctttttagtgttggcttggatatttgtaaaccattgtacagggcaaataaaacccatctttaggtggaatccaacctatggcagccaagtgtagttctcatctgaagaaccactttttctttttcaccctgaaatagttgcctgtagactttccttcacagactgatctatccaatcttattgaatccagttttgtttctcattttacccattttctacaccactgttctagttccatttcaaaaagtatcttcacttttgaattactacaattcccttgggttttatgggacaaggcctagctgaaatgagctttataaatgcataaaaatatataaaataagaatagtttatccagcaaataatcttccataccagctcaagattcatgccagcatccaataaagaatgatggcttcctttattttcattctgtctacctccttaggggaaaagacaagctgttatttgtgggtgtttttatttcaactattttttttttttcgtgttgttggcatttatttgcaaggcaaatggagaaaaatgcaggataaatgccatgactttctgcagctcttcagcctgaaggtgaggaggactggagagaagaccataagcctgtgggcatgttgtataggcgttctcagcttcagttcctgcatctgtaaaatgggaatggcgttggtgactgtgtactgggcttctgttagatgcacatagcattatacaggtgaaggggtcagcagaggaggcactcagccatgttagccattgtttctggcactgggttgctagaatccccactgtgactccagctgtactgctgacctcctcttccttcttgcttttatttttctccagtgaccactgaagtcctagcaggtacccacctcaattgtgtgtcacccagttaagtactttatgtttccacctgagatagcatgccgtcattttccctttgtgtgtgatttagggcacagaatgagcttctaggttaaaagactgtcctatttgtgcaggcctttacataattacagggttgaagcttgtttttgatggcacgctgctcatattgttggattgtttcttaaaaatttgacctttgctcatgatattgtgacctggacccattagagcaatggaagatcatagctaagttactattgtcttcatagactattcagagtaaaatgattttataaatataggtttgaataatctcttaaatcaatgcaagttcaaatgtccacaaactttgttttgtctaccctagatgactgcattattactgaacatctgatatgctttagaaaatatttcagcctttggaaacctttccgtcgctcctttataattcaactaaattcaacattgggcacaaaatacaaggttgcagtttactattctgctaactagagcttgtgatacaattagcagctcctagagctgtgcttttacatcacattctttccctatatgccctcttcacgctagatgatattcgtcatgtctgtttctgtttatagtcttccaaatctctcaatttcttcctcctcaactttagagcttcttttctgatggtcctttttttctctttccctttttattttttctgtcttcagtacaaatagttatgatccccagactttgaaattctctgcaaattgccatcaagttacatgaatttggccagactgtggcttcagaaaaataggaaatatgtcttagttatcttcatacttccttctcaaggtctagcagatacctgatagccaagtagttatcatgcaagaattatttttaaatgaattaatagtattgaatactcaatactacatacttaaaactctctctctatacataaatatatatatctcctgtgtgtgtttataatatacacatatatggccagactgtgtctggcacattagtagatgcttcataaaccttactgtatgaatgaatatatcatgcttgtgacaacaaaaccaactggttaaattggttaaaatatttcaattaatagaaattatagtcaaataaatacaaaaggacatttaaatctactccaactttcagtagctttaatcaaagtgacttattttccattctttttttttttgatttttatttcatctgcataatttaatcagtttttccttcacatattcaaaaacctacattggtatttttttctgacacgtttcccctgttagactttagtttttcttagttcatattctttttcttttcttttctttattattatactttaagtttcagggtacatgtgcatattgtgcaggttagttacatatgtatacatgtgccattctggtgcgctgcacccactaactggtcatctagcattaggtatatctcccagtgctatccctcccccctccccccaccccactacagtccccagagtgtgatgttccccttcctgtgtccatgtgatctcattgttcaattcccacctatgagtgagaatatgcggcgtttggttttttgttcttgcgatagtttactgagaatgatgatttccaatttcatccatgtccctacaaaggacatgaactcatcatttttaatggctgcatagtgttccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttacccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggttggtcaaagatcagatagttgtagatatgcagcattatttctgagggctctgttctgttccattgttctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtagcttgatggggatggcattgaatctgtaaattaccttgggcagtatggccattttcacgatattaattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacaatggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattaagagtttttagcatgaagggttgttgaattttgtcaaaggccctttctgcatctatgcagataatcatgtggtttttgtctttggctctgtttatatgctggattacatttattgatatgtgtatattgaaccagccttgcatcccagggatgaagcccacttgatcatggtggataagctttttgatgtgctgctggattcggtctgccagtattttattgagggtttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttccttcttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctatacactgctttgaatgcgtcccagagattctggtatgttgtgtctttgttctcgttggtttcaaagaacatctttatttctagcttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatctgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagactgtgtcttttaattggagcatttagtccatttacatgtaaagttaatattgttatgtgtgtatttgatcctgtcattatgatgttagctggttattttgctcgttagttgatgcagtttcttcctagcctcgacagtctttacaatttggcatgtttttgcagtgactggtactggttgttcctttccatgtttagtgcttcctttaggagctcttttagggccggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgctgagagatccactcttagtctgataggctttcctttgtgggtaacccaacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgccctgcccctagaggtggagcctacagaggcaggcaggcaggcctccttgagctgtggtgggctccacccagttcgagcttcctggctgctttgtttatctaagcaagcctgggcaatggggggcccccctcccccagcctcactgccgccttgcagtttgatctcagactgctgtgctagcaatcagcaagactcagtgggtgtgggaccctccaagccaggtgcgggatatagtctcgtggtgcgccgtgttttaagctcgtcagaaaagcgcagtattcgggtgggagtgacccgattttccaggtgccgtccgtcacccctttctttgactaggaaagggaactccctgacccctgtgcttcccgagtgatgcaatgcctcgccctgcttcggctcgcgcatggtgtgcacacccactgacctgcgcccactgtctggcactccctagtgagatgaacccggtacctcagatggaaatgccgaaatcacccgtcttctgcgtcgctcaggctgggagctgtagacgggagctgttcctattcggccatcttggctcctcccccccaggcacaatactttctaaaggcaccttgaagcctaaaagagcccttcttatactctgaggtatctcaccactgaaactggttacatacatctgtattgggaattaatggataagggtggaacaaatgaaatgcatttctgggggccagatattccaaagcagtttggggtagccttcttcctcctcctctgcaatgctttgttagttggaggctgtaaacatgccgatgctttcccaaatttgtgggaatgaatgtgaatcacagtttttggggcttcaatctcctctgcggacacataaaaaggaactttcatcaatttctaacaaggtttgagatctatgcctggatagagctggatattgatgcaaaagtaagaagcaaaagatgatttccttgagttccagcaatttcaataaaaaacacagagaccagacttgcaacaacactatagtgtcaaagagctggttcccaaaggggagcatagagtccacccataccagagacagacgagatctaacactttttgagtttaatattaatgttgcagcatggtaatgaaaactagtaaaagaatctctcttggtaaatgaatcttcactcccaaacggcaagcaggaaaaaccctaaataaataatgtgagattgatatcagaggcccatgtgcagggactcgattacaattcttggcttgtactcaggggccctcatgcattttttaagagctcatcaatattgtgatccttctgcttgctggtgaactttaaaaactacaccgaggtataaaagtagggctttgactttgttgaggcttatgattcttctcaaataaagtagatctgaataaaagacggattggaaaatcttccctggcctttaggcaagcacagaacttagcagtggttttggagcacccactatggaacgatccatgagatccaaagatggatacagttcccacacaacagccacaaggaaccacacattggggaccacctgaagcagaaccctagctgggggcttggccttgttctgccatgaagctgacagagctgtttctacaacaatgtgcatcttgaatcatcccacagaaggagctgagttaggctggaaatgagagaattccagacagagggaaggtatatttgtggagttgtaggaggccagaaagttgaaggctggagactaggggcaaggttggaggctggagaccaggggtcaaggcaaggaagacaaggctgacccctcagacgctagtaagtctctactgtgagagcagcaggaagccatggaagggggttaaacagaggaaggttgactcttactggaaatgatggcttgtctcccatttctggtttgggatacaggatgccttaggccctggtgccagcagagtgtacaggaggccacattggaagacgatggtctttgctgtcttcttacctttctgtatgctccctgggccttcgtgtggctttagcttctcacaaggcctcactgggctgtgtatgtgtgtgcgtgtttgtgtgtgtaggtggtgactgaccatcttctatgagctgggctttgtattatttcttgaccttctcaagatttgcctgtctcatgtcttcagaacccattgcctgcagtctttgatacacactattctgataaatgaatgagactgtgaggagtgttaatttaagatattaacccttttatgtgttagggtaatacccagtgtctttttactcaggagatattcaatcagtagggattcaatacacgagtgtcgtatatttgtgttttaaccgggtctgtctgagatgcagtgaacgttcagttagcctgggcagccttctttcttgtcatctgtagagctggaatctgggagcttccttctggtcactcagcagggacaaagaggcctctacccccacatcactgttctctaaggtacatgcctcccccatcactttccacctctcgaggaactggcacagcccaggatttcgcaatgattagaactgaaccccaataagctacccaagaaaaacagtgagccttttaaggggctcagaagtcagacaagagaatcagaacacagggaatacatgttctggaacaagaggacacaaacaccagcttagcaactgcagcaagtacagtgaaccagccagaccaccggacaaggtcagaggtacaggggatggcctcttgaacacagtggcaggaggatggttgcagggtagtggctgcagaagaccccatgtacatacatgctaagcttttatttcaggcaaagggcttagagttctaagcttgagaacccctcagaacaggtcctactgtcactttctgagtctgagggagagttactaagaagacactgaaattctataagagcccttaagaagctaaaattgcaaatactcctcagagagacctggatttccagcagaaatcaggattagcacatgccaatatttaggtcgacatcgagtgggcgtgaacagcagtatgtggaggctttgttggatggccccagggttcttttaacctaaaattctatgggagtgtttgaagggtcgtagttcagagggaactcttgatccctgttgtgaacgccaagctcattcctatctcctggcctttatctttgctcagctctctggaccaccagaaggatctttgcagggctccttccatcccatcatttacgtctcattgcctgagaggcctttccgggccattctttccaaaatactcccctcccacgttttatccccttcctggatttgcttctccacccagcactcaccacagtcgggaacgatactatttgtttgtttacttgatcagtggggatctctgtgggtcttgtctatcaatcactgcatcctcagttcccaaaacaggaccagtcatttagtgtccactcaacacacgcatggcaaaaaaagacagaggagcagggaggctgagagggagggagcaagccttcctctagaagggtggaacgcagagcagtgcagtgagaatgtgtgtgtgcctgtgtgtatccatgcatgggagcatgtgcttatgtatccacgtacatgtgcatgtgtgtcaacatatatgtgtccatgcatgtgtacttgtgtgtgaatgtgtatgtgtgcacgcatgtgtgtgcgcaagcacacgtgtaggcatcaaagagacttgcatttgaaaggagacccttagtataatatttatgataaacatttcaaaactgagttttagtgatgtgcagaacagaggaggaagatgcaagccccgaggcttggcaccccagctgcctgagccaagtcctcaggcagtgagggagatataggtaagtgaagctgggggtgggggttatttagctctgaagattggactgctggtgtcttgttttgatttcagagccaacatgacagatacccagacttcagagagggaaaacagcatggtcaaaatgacaactgagaatacggtggccagccttggtcagaatagtgctgacctgtgcagaggtaggctctttcttcaggtaagggctcctggcctctctgcatgccttggggcccgcctcctactctccaccctcacaccctcaggagagagtgatgcaagatgaatggatcctaaaattaaaatccagtaactctttcgaattactggcaatttagtgaattaacaagttggcaccaggcagtggccttttcccactaaaaaaaaaaaaaacaacctcaaatgcattccccaaggaaggggctgaaactcataaccttgtgtctggggcccagagggcatgagcacagagatccaaaggggctgatgctttccctaccactagtggggcaggctgtgttagggtgcatgtctgaaacttgaaactgaattaagtagcttcatgtaatggcttctcttgacggcacaggataaacatcataagaagaagaagcagtaatccaagaaggtttgcaactggctcaaaatgctacctgaaaccaagaattggaagccaccttgacccagaggaaaaaaaattgttaaactttgcagctatttctcaaaagaatagagaattttgttttctgtttgtagagatgggaatagtcatcccttatggaagaagacaataatttgctgcatttttaggacttgtaattgtacaggcaaattcaaaattcaggtagcattaaaattacagctagataatgctgcctgctttgtggatagctatcctcatttcaagggagagcacccctttatctgttgaagagatgtctttttgatttgctaagggcaagaatggaaaataagtgcgaataggaacagctccggtctgcagctcccagcgtgagcgacgcagaagacgggtgatctcggcatttccatctgaggtaccgggttcatctcactagggagtgccagacagtgggtgcgcacactgtgcgtgagccgaagcagagcgaggcattgcctcactcgggaagcacaaagggtcagggagttccctttcctagtcaaagaaaggggtgacggacggcacctggaaaatcgggtcactcccacccgaatactgtgcttttctgacgggcttaaaacatggcgcaccacgagattatatcccgcacctggcttggagggtcctacgcccatggagtctcgctgattgctagcagagcagtctgagatcaaactgcaaggtggcagccaggctgggggaggggggcccgccattgcccaggcttgcttaggtaaacaaagcagcctggaagctcgaactgggtggagcccaccacagctcaaggaggcctgcctgcctgcctctgtaggctgcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcactaccaggcctgccctaaaagagctcctgaaggaagcactaaacatggaaaggaacaaccggtaccagccactgcaaaatcatgccaaaatgtagagaccatcaagactaggaagaaactgcatcaactaacgagcaaaataaccagctaacatcataatgacaggatcaaatacacacataacaatattaactttacatgtaaatggactaaatgctccaattaaaagacacagactggcaaattggataaagaaagagtcaagacccatcagtgtgctgtattcaggagacccatctcacgtgcagagacacacataggctcaaaataaaaggatggaggaagatctaccaagcaaatggaaaacaaaaaaaggcaggggttgcaatcctagtctcggataaaacagactttaagccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcatcaagtggacctaatagacatctacagaactctccaccccaaatcaacagaatacacatttttttcagcaccacaccacacctattccaaaattgaccacatacttggaagtaaagctctcctcagcaaatgtaaaagaacagaaattataacaaactgtctctcagaccacaggtcaatcaaactagatctcaggattaagaatctcactcaaaatcgctcaactacatggaaactgaacaacctgctcctgaatgactactgggtacataacgaaatgaaaccagaaataaagatgttctttgaaaccaacgagaacaaagacacaacataccagaatctctgggacgcattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagtagaaccgaagcaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagagtactacaaacacctctacgcaaataaactagaaaatctagaagaaatggataaattcctcgacacatacactctcccaagactaaaccaggaagaagttgaatctctgaatagaccaataacaggatctgaaattgtggcaacaatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagataattttagaccaatatccttgatgaacattgatgcaaaaatcctcaataaaatactggcagaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagtcaaattgtccctgtttgcagatgacatgattgtgtatctagaaaaccccactgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaatcaatatcgtgaaaatggccatactgcccaaggtaatttacagattcagtgccatccccatcaaggtaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgaccaacctgagaaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggacctagaactagaaataccatttgacccagccatcccattactgggtatatacccaaaggaatataaatcatgctgctataaagacatatgcacacgtatgtttattgcggcattattcacaatagcaaagacttggaaccaacccaaatgtccaacaatgattggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaacatcacactctggggactgtagtggggtggggggaggggagagggatagcactgggagatatacctaatgctagatgactagttaatgggtgcagcacaccagcatggcacatgtatacatatgtaactaacctgcacaatatgcacatgtaccctaaaacttaaaataataaaagaaaaaaagaaaagaaaatactgctaaaatacatccaactcaatacttttggtaaatattacttgttgctaataaaaagtttagatataagaaaaaaaaaaagaatgtattgtgcctcattcatttgtctaaaggcaagagcaccaaggctcaaaagggtcacaaaactacctggaggcagaagcagaggcagagacaggatttcaacaccaagccctgcactctgtaactactgctctttccactggaatcagctcctgcctcagcgggtgccaatggagaaagacctgggggttttgccttctgattacagttccattggaccatctcttattttcttccatgaagaactgaggtcgtaactccttgtggactagtattctgaggctgaggggtacaactgcttatcctggttgaattcaatgctttataagtagaattaaagtgaaataaggaacacttggccttatgaattctgatcatctaaaacagagtttctcaacagcagcaccgttagtatttgaagccagatcattcttcgtggcaggggctattctgagcattggatgatgttgagcagcacccctggcctctgaccaataggtatcaatagtgtcaccctcccctgtgttatgacaatcaaaatgtctccagactttgctacatgtcccctggggacaaagccaccctcagtggagagcctctgatctagtgttcagatattttcccctagtgtggtgcctgggagatagcaagaaccatagcaagaaccattgtttgatgatggattaatggaatgcacatccattttctgaattgcttcattcttgttatttcagtattgattttgccatccttcttccaagaactgaaatacattcaaaccttgcgtgtgtctgaatagattgagaaaattcaggaagttttgctttcctaggtttcagctaaaaggaggcaggtttagttcagcagttttcccacagtcaggccaaccatggttctaatgcaccgttagtggagggggacaagctctgagtgtgaatctgctgatggatgtggggcctgcagaaggaatctgtacatttcaggaccagaggcaaggaggagcttgtgatactagtatgcaaagtggttagagaaagagagagaaatcaatgctgacctatttaatcagaacttttggagacattaatggcactgaaggtccccagagggcagcaacagaaggatgagaaatgaagcatgatgtcaaataagaaagcaaaatgctgcaataatgggtaaagcgtctcatcctcaaggcggaagtcaaagcagctgcctgggttccctccagaaaggcagtgatgggtgcagcctgtgatctgcactgggttttggtgaggctgatgagaaaagaatgagaaatgggtgccccagtgatggatgggccagtggtccttgtatggtgcacacatctttaaagctccacaagggccgttcaaagtgggtggtacacatttattctcatagtactcacctttctggtgccctcttcctccactgctccttaccactgtcccagatggttaccatgttccccttttcccttctctatttgtgactctgtctctaatttttatctgtctaccgacctgcgtagctatgtttcttttctttttttttttttttttttttgagacggagtctcgctctatcgcccaggttagagtgctacgtttctttctttctgcctccctgtgtgtgtttccatctctctgatccctctctctctctctgtgtgtctcttcccctctctctcatccatcctccctcacacccccccagccttattcatctcagcctcccctgaccctggtatgttcctgcatctcagtccctgaactcagtttcccagagcccttctctgtgcttggccatctccaccttctccatccctcaccctcacttagggtctctgacaggaagggcattggcctcagggcagagcacagtgggttcatggtgtgcaaatccaccattacagcccaaagaagtcagcagggggaccctgtcccaaaggcccaggcaggactctgtgagcctttgtattcatgctgggcctgggctggagacactaactgggtttagctcactgggaaggaaccggcagtgcgggcaggtaggtgagcagggcagaaggagggcatggaagtgagttcaagctcagttcctcctgccgtcagaccatgagctggatcctcctaccagcgctagtcctttccttctccatgcctcaacttcccctttcagtatgctgctcttccagttagattttccctcccatatctctctcctctctctctctctctcacacacacacacacaccacacttttcttgatgtgtatgccctgcttgctgtcttattgcactcagctacctctttgtccctcccctgcttcatgtttttaccccttttctatgcctttgatttcgtggatagaagttttagcacaagggaaacaaaacaaggaaaagaaggaaggaaggaaggaagttagttttcatgttgcctgagactgggtaatttataaagaagagatttaatggactcacagttccatgtggctggggaagcctcacaatcatggcggaaggtgacaggcacatcttatatggtggcaggcaagagaaaaatgagagccaagtgaatggggcaaccccttataaagccatcagaccttgtgagactcatccactaccatgagaacagtatgggggaaaccactgccatgattcaattacttcccactgggtccctcctacaacacatgggaattatgggagctacaattcaagaagagatttgggtggggacacagccaaactatattagaaggaaaataaaggaaagaatggagggaatgagagaaagagataaagagacaggaggaagggaaagaaggagggagaaggggaaggggggaaatgtggagaaaggttgagggaagcaaagcagaggaagtgaagtgacaccatagagtatggaaatcattgccaaaaatataagtgaattttgtcatagctggttttactgaaacaagtactaagactgggcatttgcctttgccagtgtttatggcaatgatagatttacacacagggatgccgagggcatttgcacccagtggaggtgagtacccatgacatggtgacccaatatggtgaccctggagttcaaagcacaaaggatccttggacttcttctggatccctgctacttttcactgcatgggagaactggagagggtcctgaatggtaagctgtggggcaggtgagctggggagtaccagacacacccaagaaggccctgctccctgtggaaacagattccttaatccagggaaagctttcacatgcattatctaagttactcttcaccacagccctctatgctagattctgctattactcccattttatggataaggaaactgagcccagatctagacctgtcagataaatgcaggcaatgttatcctggcctctattcctcatcaccacaattaaagccaagggctggtttctcccatgtgacacaggcagatggcaggcagggcactggggaatgctgtgccaatgtccccatggtcaccacagtctcacacatcatgtgtctctttctggatcaataactgcatgagttgtcttgctatgtgtaggcatcttaagcatataggaggacaattagagaatccaggtcctcagaggctttgttgatgagcacatgggctggggttttaaagaacataagtgcctgtaataacagagcttaccgctgactactctggtgctctcttctctgtaagtgcattaattattgagagaactcatttgcagcacgcacacagttgaaagggctactttggacgctaatcagaaaatacacattgttgaagggagctaattagagaatcacacaactttgtagagctttgcctgaaaaactggatcaatcagagatattggatattcagagatacttgtcagacctgcaataaacaaatacatgtaggcattgcatgtaaagatgtaacactgagctgtttccattaggaaggatttttatttctcatctgtccatttcagtgactggagccctcttgataactacatctgaagtgggagcccctgcaggcaggatgcagatattatgagtcctatcttttgatttcaaacacgtttcttccttccaatctaagacctgcgcattctgcagtccagccgggaccacaatgctattactttgtggaggtttaataagccctgtgcattcaatggggagtcactaaaatagagatttatccccaaatctgttgcaacacattacaaatatgtcaagcgttcgtgattgagtcgggtctcagaaagagcatgaggcattcttgacctatatatttaaagaaccctggaggtaaatgtctgtcccatttcctcaaatatacaaacaacatgataaaaataatattgaataaaaataatttaaaatttaaaataaataaataataaaattaacaatttgtttatcagattcttaggaataaagacataatcactttcaggagattgaatgtataaaactacaaatcgcaagactggtcaattaaggtgtattgattcacatacaaaaggatgttcacattacaaaagaattattcaattttttcttaatgacagctctgttaatgctttcatcactttttttgcaaataatccctggttagagaagactgaagaataactaccataaacgaacattagtaattttcaatgccatcaagtttcataaagttttaaaaactcaaattctttcaggaacaaagctattctatatggcaagagattcctgaaccctccacattagtgtctataatgggtaggcctcatgccattatatttttctaagccaaagttcagatgcatcaagttaccaaaaccctttttacaagaatgccaaattatgtaattccttcctataagaatgttatgggccaggtgcggtggctcacgcctgtaatcccaacactttgggaggctgaggcgggtggatcacccgaggtcaggaatatgagaccagcctgaccaacatggagaaaccctgtctctactaaaaatacaaaaattagccaggcgtggtggtgcatgcctgtaatcccagctactcaggaggctgaggggggagaatcgcttgaaccgggaggtggaggttgtggcgaaccgagttgcactccagcctgggcgacaagagcaaaactccatctcaaaaaaaaaaaaaatgttatggcccatttattgtctaggtatttattactgagcttcccttggatccagttgacagtaggaagccaacgttgaattagaatgcctttaatttcagtgagcccagtccagtgtcgctggggtcatttagtgaattacatgctgccattcccagtgaaatcatataactactcatcatcacttagtagaataaagatatcctgaaaaagctaaatggagttttgaatcataaatcccaagtggtgcaacaatgtaataacacaatgacaaagaaatcatttgctgcatttcccaaaaataaggtcattgctcctgttgttcgcggaaaaaaattttcaagacgggtaataacattttgaaaatttgtatgctcatttaaattgtataaaatgcatttttagggcttgatttggccatatttatttttagttctcttatactttttttttttttttttgagatggagtttcatccttgttgcccaggatagagtgcaatcgtgcagcaacctccaatgcgcaggttcaaaagattctcctgcctcagcctcctgagtagctgggattacaggcgtgtaccaccacgtccagctgatttttctattttcagtagagacggggtttccccattttggcctggctggtctcgaacacctgacctcaggtgatccattgcctaggcctcccaaagtgggcggggattacaggccagttctcttatactcttgaatagtcctttccttctgttatgctggttgttctttttctgtgggtaaacttgaaggtgtttcctaaggttcaggctttaaacactgtctaaacacatatcactttcattgccccgctagcagagcagctggctaatggcagccctcacttggctcaggtggtctcagatcccctcagcctgcaccttcggggcctatgggtccaaaggggctggatgaggaaggctcaattaattattgttagcatacagtaacataaggaaagcaggggatattttgaagcaaaagaaacaagaatgttcagttactttagactcagaaaacgagcagtgagtcatcctagagctacgtttctatgataaaaatacctactagatatcttgtcttgaatgtccccagctgcatcaaactcagcaggtctgaaactaaacccttcatcttttgtcatcaaagtacgatctttcccctatacaccctttcacagttagtgatttcactgtccacacagtttcctgagcttagagcctgggaaggagtcacccctaaccccttctcctctgtcaccactcccacttgtcattgactctgaagccaccttccttggacccccttcatatctcacaatttaattccctctctcacatcccacagctgctcctgagctcagaccatcatcatatctctctccctgcacatcctttaccctgggccctcgctccaggaccacacaccaccagcccattctctagacagagttttgcacctggtatgtcacgagttacaggtgtgccaagatggtgagtccttcagacctcaaggtggccagaaacagctccctgggttcatcccagtgtactgcacaaataccccttgtctgcctgttcctcaaaaagtgggaagcactgggctggataaggcacactgtctgtaccaaaacagcagaaactcagacccagcgtcagtccagctcaagtcaggcagtgttggttgcaaagtggacctggtggctgggccctaattgtgctcatgctttgcaaggaggtgatgggatatattaaagccttgaaacagggccctgaagatgggaatgagaaggagtcaaggccaggtggctcatgtctgtaatcccagtgctttgagaagctgaggcaggagcatcacttgagttcaagagtttgagaccagcctgggaaaccaagcaagaccctgtgtctccagaatattttaagaataataattagccaggcatggtggtatgtaactgtagccctagctactctggaggctgaggtggaaggtttgcttgagcccaggagtttgaggctacagtgagccatgaatgcaccattgcactctagcctgggcaacagagcaagactctatctcttcttgtttaaaaaagaaaaaaaaaaaaaagagtcaagagatattttgccggtagaattaacctggagagaaaggtgtcagtgaaacctctgaggtttcaaggatggaaggatggtgataatgttacacaagatggagcacacaggagagaagcagtatttgggattgggaggggatggggttggccttcattaactgaattggtagactgtggccttcagaattccagatggacactcgtgtggaaatgcctagcaaagcacctaaaattcacatctagggctcaggagaaagagcaaaatggaaaagatagatgggaatgttatttataaagcaatgaggaaagcagccaagccttccgagagaggcctgagagcaggccactgaacactccgtatttagaggaaagacagagaaaaggatccagtcaaggaaagtgagaaagggtggccagaaatgtaggcagagatctggaagaccacagtgccctggcagctgaaagggccaacaacaaaaatatcaacggcatcaaatgctatagtaatgcaggtaggaagaggacgaagaggaaaccagagaatttggcaatgagaggtcagggtgacctttcagtagctgatggtgaaagaagctgtgtcagttcaggtttttgagaagcgcctagcaagacagattagacacacaaggaatttattggggaaattcttgtgaagaaggaagcaaaaggaagcaggaggtggcaaggagagtctggagaccataacagaggtccgacacctgtgagaggagaaggcgaaggagggattggttggaggcacgtcaggctgcggtgcacttctgagaaggctgcagtgaggctgatggggtatccctgagcaaaggatgcctgttagggagatcctgcatcgggcggggacggccatgagaaaagccctgtcacgcttgtcattggcttgcagcatcccagagaacacatgcctcccttcctgcagcagatgctcttggtttttttgttttggtttgggttttttgtttgttttgttttgttttgttttgttttgtttgagtcttgctctgtcacccaggctggagtgcagtggcataatctcagctcactgcaacctcctcctcccgggttcaagcgattctcctgcctcagtgtccccagtactgggactacaggcgcccaccatcatgcttggctagtttttgtatttttagtagagagggggttttgccatgttggcctggctggtcttgaactcctgacctcaggtgatccttccgcctcggcctcccgaagttctaggattacaggcatgaggcacaccgtgcccagccagcagatgctcttgaaggagacctgaggttatgtttgcgtggcaccacagaagccagagtgaccataagcaggaagtagaaacactagaattctggtctaagctgctgtcatctctatacacagcatggctgaaacagaagagccacgcagaagttagcaggtaggcagggcctggtaagaaggccataagctgtggcgctttcacccaaagccatcatgaagacccataactaagtggctggccaaggtcacaaggtttcatagaattgccaggacgagagccagctgtccatcttcgcttggcgtccctggctctctcctcaaaccctgtgctctccctgtacttccaatcacatgcggggtttggtctatcaccgttcgtacccagtggacactgatgcctttgatgtatgtttttctttcaacgatggtgtgttgaaggattctgttacctccattcctccatttctgtacaagtaagttaatacaagtaagtaagtactgtaggaaaatgagctcctcccgcgcccagggaggaggtaggaggacgattccacctgtctttgtggtgagcgctgaaggaggatcttgagaaaggcacctgtgtgcagcggcattctcatctctaaagcccgcatggcttcccgtgtgcacacaggacattctgcccatgtttaccaaatgaagacaccaactaactaccctgtctttccttctaggtgacctcatacatttgcctccataccttagaatggactttttgttaaaccgaggtggtccaggcaccagcagggacctgagcttaggacaagcatgcttggaacctcagaaaagccggaccctgaagcgccccacggtcctggagcccatcccgatggaagccgcctcctccgcctcctccacgagagaaggacagtcgtggcagccgggggccgtggccacattacctcagcgggagggagcagagctgggacaggcagctaaaatgagcagctcccaagaatcactgctcgactcccggggccatttgaaaggaaacaatccttacgcaaaatcttacaccctggtataacagacagcatgactggacagcggttgtaaatacaattcaaacaattcaatcaaagctaccttttttttacggaattccaatatttataattaaagaaaattgccaaaatatattaaaaaaaaaaaagagaaaatactgaaaccacagacagtgcaaagactctcctgctttttttctgtctgagtgtgagctccatccgcctgggcatctgattttttgggaaagaagtccagttttatgatcttcacaggctattgcatttttactgattttctacaaaagtgcatgggggggattaattaaaccttctgactggaagttctatcacacaagaggcaagaaagaaaacagggtgggtgggaaatcagcctatttgtgaatttaaaaggaacaccgatttgcgggcaggggaaaacttcagtcacgtttgcacacctttctttcccattagaaaccgggttctcaatttggtcttcttttgttgttaattaggatgagtgccgtcagtgaaggggtggggggaatcaatttggttttctctcttgtttcttttttaatttaatgagacactctttgcattttgtctaagcgaaataaaaaagaaaaggttgtctgcctttatttccatgtctgcttctctcgtcttctgccagtggcctggtcctccttcccattgacacttctgtttggaaacaccaggcctgaacccagagcccaattcaataaaccagagtcgatactaacaccctgaactcctcaggaatctccaggaagcacaaagaaggtgcagctcctgctctcaagctggagaggacaaaatgcaggctggtctccaccgcaaccagaggccagcccaagtattcgaagcccgtcgcaaagctctgccccttgcctgcccatggccagagttcaactgactgtggcctatgggccaaatccagcctcctgctgttttttaaataaagttttattgaaacaaggccacatgcactatttgctattgtctatggctgctttcatggcacaatggtagagctgaatagttgcagcagagatggtatagcccatgaagcctaaaatatttattacctggcccattacaggaaacatttgccagacccgtgctctggagtctgaaatgtagccccagcttgcgtgacaaggggcaagatcgtgcatcttaccctccatgacttttcctatctccactatgcctggtatgcaaatttgtgatagaccatcttaataaacattgcctgaatcctctgtaaccagaggaaagtgatgttcctctaaaatctaagtttttactttcctttccctcactttatctcccatgtggctcatcctaagagagaatttactcataaatagtcggaactgcattctttatcccacaaccctcacagggtttgctttatgaaagaggatgtaatcctcccctggctgcaacactccattccaggctcacttccataaaatggaaagataaacaggtctttgtgtcagagatttggcattaaccagaaaacatgatcaaatatccacagctgctcagtctcccaggctgaagattctctacaggcttccattaaggccaccaacatagactggtgccagttattaccatcttgggaacatattcagaaatgtctttccttccctccctccctccttctttcccatcctttcttccttctatttattttccaggcaggcccatttgtctgcttagattcagtgacacagaatgggtccaggaccatgtcaagaccacctgctgatgctagtgttagatgactccaggaatgtgaggtgtgcatccatggtttcagaatgtaatccgtgttgacgtgtactgtttgcatactctcagactgttttttttttatgcaaaagaaatgttactttctgggggaaaaaattaaaagtctatctttcatcaacctaaaacttctatatcccccaaacatagaagtttacctttttaacatttttctctcaacctgtacaaaaataaaaaaattctacatta

SEQ ID NO: 201 - DNA, 92 bp, Homo sapiens
attggaaggtcagccaatcaggcgcggagctgctcccggtagctgccacctccgaggcgcgcgccacgccggggttccctcgcggctttgga

SEQ ID NO: 202 - DNA, 87 bp, Homo sapiens
tccgtgtgctccaccctttgaattcagaacgacatagtggatactccgtggggctgctggaatcttccattcccactgccttatctt

SEQ ID NO: 203 - DNA, 99 bp, Homo sapiens
aaggtgcgaactcctctttgtctctgcgtgcccggcgcgcccccctcccggtgggtgataaacccactctggcgccggccatgcgctgggtgattaatt

SEQ ID NO: 204 - DNA, 71 bp, Homo sapiens
tgttcactggaggactcatcagaggtcccattctcctttttgtgtctttcatcaaacaccctcatggactg

SEQ ID NO: 205 - DNA, 22 bp, Homo sapiens
attggaaggtcagccaatcagg

SEQ ID NO: 206 - DNA, 19 bp, Homo sapiens
tccaaagccgcgagggaac

SEQ ID NO: 207 - DNA, 20 bp, Homo sapiens
cgcctcggaggtggcagctc

SEQ ID NO: 208 - DNA, 20 bp, Homo sapiens
tccgtgtgctccaccctttg

SEQ ID NO: 209 - DNA, 24 bp, Homo sapiens
aagataaggcagtgggaatggaag

SEQ ID NO: 210 - DNA, 22 bp, Homo sapiens
ccagcagccccacggagtatcc

SEQ ID NO: 211 - DNA, 22 bp, Homo sapiens
aaggtgcgaactcctctttgtc

SEQ ID NO: 212 - DNA, 22 bp, Homo sapiens
aattaatcacccagcgcatggc

SEQ ID NO: 213 - DNA, 23 bp, Homo sapiens
cccctcccggtgggtgataaacc

SEQ ID NO: 214 - DNA, 20 bp, Homo sapiens
tgttcactggaggactcatc

SEQ ID NO: 215 - DNA, 19 bp, Homo sapiens
cagtccatgagggtgtttg

SEQ ID NO: 216 - DNA, 28 bp, Homo sapiens
aggtcccattctcctttttgtgtctttc

The invention claimed is:

1. A method for quantitatively detecting in a sample from an individual an amount of a species of DNA originating from cells of a given type, which sample comprises said species of DNA in admixture with differently methylated DNA not originating from cells of said type, wherein said species of DNA originates from cells of a fetus and/or the placenta of a fetus and said sample is from a pregnant female; said method comprising the steps:
  (a) treating the DNA present in said sample with a reagent that differentially modifies methylated and non-methylated DNA;
  (b) quantitatively detecting in said sample the presence of methylation in said species of DNA at two or more differentially methylated regions (DMRs) that are differently methylated between said species of DNA and the DNA not originating from cells of said type, the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample,
    wherein said DMRs are hyper-methylated in fetal DNA and hypo-methylated in maternal DNA, and
    wherein said DMRs comprise at least one, or at least two, methylation site(s) specific for said reagent, and at least one of said DMRs is located in a region and/or gene selected from the group consisting of SEQ ID NOs 15-187 or located in a region and/or gene selected from the group consisting of: SEQ ID NOs 188-199; and
  (c) quantitatively detecting an amount of total DNA present in said sample using at least one other region, wherein there is no detectable difference between modification by said reagent at the other region(s) of DNA originating from cells of a fetus and/or the placenta of a fetus as compared to the other region(s) of maternal DNA,
    wherein, said detection in step (b) and said detection in step (c) are made using the same aliquot of DNA of said sample, and in the same reaction/detection vessel, and effectively simultaneously for such DMRs and other region(s), and using the same detectable label(s) for each of said DMRs and a different detectable label(s) for said other region(s).

2. The method of claim 1, wherein prior to or as part of said detection in step (b) and/or step (c), each DNA region comprising said DMRs and/or said other region(s), respectively, is(are) amplified.

3. The method of claim 1, wherein each detectable label used in step (b) and/or step (c) is independently selected from the group consisting of: fluorescent, protein, small molecule or radioactive label.

4. The method of claim 3, wherein each detectable label used in step (b) and step (c) is fluorescent.

5. The method of claim 1, wherein two of said DMRs are located on different chromosomes.

6. The method of claim 1, wherein said other region is located between about 20 bp and about 20 kb upstream or downstream of, and/or within the same gene as, at least one of said DMRs.

7. The method of claim 1, wherein said detection in step (c) comprises using at least two of said other regions; wherein, the number of said other regions is the same as the number of DMRs used in step (b); and wherein, one of said other regions is located between about 20 bp and about 20 kb upstream or downstream of a DMR used in step (b) and each other of the said other regions is located between about 20 bp and about 20 kb upstream or downstream of another of said DMRs.

8. The method of claim 7, wherein: (A) said detection in step (c) is made using the same detectable label(s) for each of said other regions; and (B) said detection in step (c) comprises multiplex real-time quantitative probe-based PCR using at least two labelled probes each of which is specific for one of said other regions.

9. The method of claim 1, wherein said detection in step (c) and said detection in step (b) are made using the same aliquot of DNA of said sample, and in the same reaction/detection vessel, and effectively simultaneously with each other, and by multiplex real-time quantitative probe-based PCR using at least one labelled probe specific for each of the said DMRs and other region(s).

10. The method of claim 1, wherein said species of DNA is circulating cell-free DNA and said sample is a plasma or serum sample.

11. The method of claim 1, wherein said other region is located in a portion of the genome and/or gene selected from the group consisting of: GAPDH, beta-actin, ALB, APOE, RNASEP, RASSF1A, TBX3, HLCS, ZFY, CDC42EP1, MGC15523, SOX14 and SPN; and/or wherein,
  said other region comprises a region without a methylation site specific for said reagent and said locus is located in the genes RASSF1A or TBX3, and/or wherein,
  two or more of said other regions are used in detection step (c) and comprise those located between about positions 14,220 bp and 13,350 bp of RASSF1A and about positions 12,400 bp and 13,000 bp of TBX3.

12. The method of claim 1, wherein said other region is located between about positions 12,400 bp and 13,000 bp of TBX3.

13. The method of claim 1, wherein said pregnant female is susceptible to a pregnancy-associated medical condition selected from the group consisting of: preeclampsia, preterm labor, intrauterine growth retardation and vanishing twin.

14. The method of claim 13, wherein said pregnancy-associated medical condition is preeclampsia.

15. The method of claim 1, wherein said sample is a tissue sample or a sample of biological fluid selected from the group consisting of: whole blood, a blood fraction, urine, saliva, sweat, tears, phlegm, vaginal secretion, vaginal wash and colonic wash.

16. The method of claim 15, wherein the sample is a plasma or serum sample.

17. The method of claim 1, wherein said reagent that differentially modifies methylated and non-methylated DNA comprises bisulphite.

18. The method of claim 1, wherein said reagent that differentially modifies methylated and non-methylated DNA comprises an agent that selectively digests unmethylated over methylated DNA, wherein, said agent comprises:
at least one methylation sensitive enzyme;
at least one methylation sensitive restriction enzyme; and/or
an agent selected from the group consisting of: AatII, AciI, AclI, AfeI, AgeI, AgeI-HF, AscI, AsiSI, AvaI, BceAI, BmgBI, BsaAI, BsaHI, BsiEI, BsiWI, BsmBI, BspDI, BsrFI, BssHII, BstBI, BstUI, ClaI, EagI, FauI, FseI, FspI, HaeII, HgaI, HhaI, HinP1I, HpaII, Hpy99I, HpyCH4IV, KasI, MluI, NaeI, NarI, NgoMIV, NotI, NotI-HF, NruI, Nt.BsmAI, Nt.CviPII, PaeR7I, PluTI, PmlI, PvuI, PvuI-HF, RsrII, SacII, SalI, SalI-HF, SfoI, SgrAI, SmaI, SnaBI, TspMI and ZraI.

19. The method of claim 18, wherein said reagent comprises at least one methylation sensitive restriction enzyme and wherein: (i) said DMRs comprise at least one, or at least two, site(s) of methylation recognized by said methylation sensitive restriction enzyme; (ii) said other region does not comprise a site of methylation recognized by said methylation sensitive restriction enzyme.

20. The method of claim 18, wherein said reagent comprises two or three of the methylation sensitive restriction enzymes selected from the group consisting of BstUI, HhaI and HpaII.

21. The method of claim 1, wherein each of said detection steps comprises quantitative detection and said detected amount of said species of DNA is expressed as a relative concentration of said species of DNA to the total DNA in said sample.

22. The method of claim 21, further comprising the step:
comparing the amount of said species of DNA detected with a threshold amount and/or reference distribution of amounts, wherein: (x) an increase in, or outlying of, the amount of said species of DNA indicates an increased risk of the individual suffering from or developing a medical condition; and/or (y) an amount of said species of DNA in excess to said threshold, or outlying from said distribution, indicates that a diagnosis for an abnormality in the said species of DNA present in said sample may be performed on said sample.

23. The method of claim 21, further comprising the step: performing on said sample, a diagnosis for an abnormality in said species of DNA present in said sample, wherein said diagnosis is a prenatal diagnosis.

24. The method of claim 23, wherein said diagnosis comprises a step that uses a detection technology selected from the group consisting of: DNA sequencing, SNP analysis, digital PCR and hybridization.

25. The method of claim 23, wherein:
said abnormality is a genetic mutation or a chromosomal abnormality associated with a fetal abnormality and/or a congenital disorder; wherein:
said genetic mutation is selected from the group consisting of: color blindness, cystic fibrosis, hemochromatosis, hemophilia, phenylketonuria, polycystic kidney disease, sickle-cell and disease, Tay-Sachs disease; and/or
said chromosomal abnormality is selected from the group consisting of: a trisomy, trisomy 21, trisomy 18, trisomy 13, a sex-chromosome abnormality, Turners syndrome, Klinefelter syndrome, Noonan syndrome, Triple X syndrome, XXY syndrome, Fragile X syndrome, XYY syndrome, XXYY syndrome, a chromosomal deletion, Prader-Willi syndrome, Cris-du-chat syndrome, Wolf-Hirschhorn syndrome, 22q11 deletion syndrome, Duchene muscular dystrophy, Beckwith-Wiedemann syndrome, Canvan syndrome, and neurofibromatosis.

26. The method of claim 23, wherein said abnormality is a chromosomal trisomy.

27. The method of claim 26, wherein said chromosomal trisomy is trisomy 21, trisomy 18, or trisomy 13.

28. A method for detecting an increased risk of an individual suffering from or developing a medical condition; said method comprising the steps:
(i) conducting the method of claim 21; and
(ii) comparing the amount of said species of DNA detected with a threshold amount and/or a reference distribution of amounts,
wherein an increase in, or outlying of, the amount of said species of DNA indicates an increased risk of the individual suffering from or developing said medical condition.

29. The method of claim 28, wherein the individual is a pregnant female susceptible to or considered at risk of being susceptible to suffering or developing a pregnancy-associated medical condition selected from the group consisting of preeclampsia, preterm labor, intrauterine growth retardation and vanishing twin.

30. The method of claim 29, wherein said pregnancy-associated medical condition is preeclampsia.

31. The method of claim, 21, further comprising the step:
comparing the amount of said species of DNA detected with a threshold amount and/or reference distribution of amounts, wherein: (x) an increase in, or outlying of, the amount of said species of DNA indicates an increased risk of the individual suffering from or developing a medical condition,
wherein the medical condition is a pregnancy-associated medical condition selected from the group consisting of: preeclampsia, preterm labor, intrauterine growth retardation and vanishing twin.

32. The method of claim 31, wherein said pregnancy-associated medical condition is preeclampsia.

33. The method of claim 1, further comprising the steps:
detecting an amount of total DNA in a standard sample of DNA of known amount using the same other regions(s) as used in step (c); and
comparing the signal detected from said standard sample of DNA to the signal detected in step (c).

34. The method of claim 33, wherein each of said detection steps comprises quantitative detection and said detected amount of said species of DNA is expressed as an absolute amount of said species of DNA in said sample.

35. The method of claim 1, wherein said DMRs comprise at least one, or at least two, methylation site(s) specific for said reagent, and at least one of said DMRs is located in a region and/or gene selected from the group consisting of SEQ ID NOs 15-187.

36. The method of claim 35, wherein at least one of said DMRs is located in a region and/or gene selected from the group consisting of: SEQ ID NOs 15-53 and 148-187.

37. The method of claim 1, wherein at least one of said DMRs is located on human chromosome 12.

38. The method of claim 1, wherein said DMRs comprise at least one, or at least two, methylation site(s) specific for said reagent, and at least one of said DMRs is located in a region and/or gene selected from the group consisting of: SEQ ID NOs 188-199.

39. The method of claim 1, wherein at least one of said DMRs:
is located on a human chromosome selected from the list consisting of: chromosome 21, chromosome 18, and chromosome 13.

40. The method of claim 1, wherein at least one of said DMRs is located in a region and/or gene selected from the group consisting of: SEQ ID NOs 54-147.

41. The method of claim 40, wherein at least one of said DMRs is located in a region and/or gene selected from the group consisting of: SEQ ID NOs: 56, 66, 73, 87, 102, 126 and 143.

42. The method of claim 1, wherein at least one of said DMRs:
is located on a human chromosome selected from the group consisting of: chromosome 1 to 12, chromosome 14 to 17, chromosome 19, chromosome 20, chromosome 22 and chromosome 23.

43. The method of claim 42, wherein at least one of said DMRs is located on human chromosome 3 or human chromosome 19.

44. The method of claim 42, wherein at least one of said DMRs is located on human chromosome 5.

45. The method of claim 1, wherein each of said DMRs is located in a region and/or gene independently selected from the group consisting of: SEQ ID NOs 54-147.

46. The method of claim 45, wherein at least one, or each, of said DMRs is located in a region and/or gene independently selected from the group consisting of: SEQ ID NOs 66, 102, and 126.

47. The method of claim 1, wherein the other region is located upstream or downstream of one of said DMRs within a distance selected from the group consisting of: between about 15 kb to 10 kb, 12 kb to 8 kb, 10 kb to 8 kb, 11 kb to 7 kb, 11 kb to 10 kb, 9 kb to 8 kb, 8 kb to 6 kb, 6 kb to 4 kb, 4 kb to 2 kb, and 2 kb to 500 bp.

48. The method of claim 1, wherein two species of DNA are detected in said sample.

49. The method of claim 48, wherein:
in at least one detection step (b):
the presence of methylated DNA at a first set of two or more DMRs is used to indicate the presence of an amount of a first species of DNA in said sample and the absence of methylated DNA at said first set of DMRs indicates the absence of said first species of DNA in said sample; wherein at least one of said first set of DMRs is located in a region and/or gene selected from the group consisting of: SEQ ID NOs 15-53 and 148-187, or located in a region and/or gene selected from the group consisting of: SEQ ID NOs 188-199;
the presence of methylated DNA at a second set of two or more DMRs is used to indicate the presence of an amount of a second species of DNA in said sample and the absence of methylated DNA at said second set of DMRs indicates the absence of said second species of DNA in said sample; wherein at least one of said second set of DMRs is located in a region and/or gene selected from the group consisting of: SEQ ID NOs 54-147; and in at least one detection step (c):
a first amount of total DNA present in said sample is detected using a first region that is not differently methylated between said first species of DNA and the DNA not originating from cells of said type, the modification of which first other region by said reagent is insensitive to methylation of DNA, wherein said first other region is located between about 20 bp and about 20 kb upstream or downstream of at least one of said first set of DMRs; and a second amount of total DNA present in said sample is detected using a second region that is not differently methylated between said second species of DNA and the DNA not originating from cells of said type, the modification of which second other region by said reagent is insensitive to methylation of DNA, wherein said second other region is located between about 20 bp and about 20 kb upstream or downstream of at least one of said second set of DMRs.

50. The method of claim 1, wherein at least one of said DMRs is located in a region and/or gene selected from the group consisting of CD48, FAIM3, ARHGAP25, SELPLG, APC, CASP8, RARB, SCGB3A1, DAB2IP, PTPN6, THY1, TMEFF2 and PYCARD.

51. The method of claim 1, wherein at least one of said DMRs is located in a region and/or gene selected from the group consisting of RASSF1A, TBX3, HLCS, ZFY, CDC42EP1, MGC15523, SOX14 and SPN.

52. The method of claim 1, wherein at least one of said DMRs is located in a portion of the genome and/or gene that is RASSF1A or TBX3.

53. The method of claim 1, wherein at least one of said DMRs is located between about positions 4,700 bp and 5,600 bp of RASSF1A.

54. The method of claim 53, wherein at least one of said DMRs is located between about positions 5,100 bp and 5,300 bp of RASSF1A.

55. The method of claim 1, wherein at least one of said DMRs is located between about positions 1,600 bp and 2,400 bp of TBX3.

56. The method of claim 55, wherein at least one of said DMRs is located between about positions 1,800 bp and 2,260 bp of TBX3.

57. A method for detecting a chromosomal aneuploidy in a fetus carried by a pregnant female, said method comprising the steps:
(A) determining, using a first method, in a sample taken from said pregnant female the amount of a first species of DNA that originates from cells of a fetus and/or the placenta of a fetus, wherein said first species of DNA is located on a chromosome relevant to the chromosomal aneuploidy or within a section of a chromosome relevant to the chromosomal aneuploidy, and wherein said first species of DNA that originates from cells of a fetus and/or the placenta of a fetus is distinguished from its counterpart of maternal origin in the sample due to differential DNA methylation;
wherein said first method is for quantitatively detecting in a sample from an individual an amount of a species of DNA originating from cells of a given type, which sample comprises said species of DNA in admixture with differently methylated DNA not originating from cells of said type, wherein said species of DNA originates from cells of a fetus and/or the placenta of a fetus and said sample is from a pregnant female; said first method comprising the steps:
(a) treating the DNA present in said sample with a reagent that differentially modifies methylated and non-methylated DNA;
(b) quantitatively detecting in said sample the presence of methylation in said species of DNA at two or more differentially methylated regions (DMRs) that are differently methylated between said species of DNA and the DNA not originating from cells of said type, the modification of DNA of such DMRs by said reagent is sensitive to methylation of DNA, wherein the presence of methylated DNA at one or more of said DMRs indicates the presence of said amount of species of DNA in said sample and the absence of methylated DNA at said DMRs indicates the absence of said species of DNA in said sample,
wherein said DMRs are hyper-methylated in fetal DNA and hypo-methylated in maternal DNA, and
wherein said DMRs comprise at least one, or at least two, methylation site(s) specific for said reagent, and at least one of said DMRs is located in a region and/or gene selected from the group consisting of: SEQ ID NOs 15-53 and 148-187, or located in a region and/or gene selected from the group consisting of: SEQ ID NOs 188-199;
(c) quantitatively detecting an amount of total DNA present in said sample using at least one other region, wherein there is no detectable difference between modification by said reagent at the other region(s) of DNA originating from cells of a fetus and/or the placenta of a fetus as compared to the other region(s) of maternal DNA,
wherein, said detection in step (b) and said detection in step (c) are made using the same aliquot of DNA of said sample, and in the same reaction/detection vessel, and effectively simultaneously for such DMRs and other region(s), and using the same detectable labels(s) for each of said DMRs and a different detectable label(s) for said other region(s)

(B) determining, using the method of claim 1, the amount of a second species of DNA that originates from cells of a fetus and/or the placenta of a fetus in said sample, wherein said second species of DNA is located on a reference chromosome, and wherein said second species of DNA that originates from cells of a fetus and/or the placenta of a fetus is distinguished from its counterpart of maternal origin in the sample due to differential DNA methylation;

(C) determining the relative amount, or the ratio, of the amounts from (A) and (B); and (D) comparing said relative amount or ratio with a threshold and/or reference distribution of amount(s) or ratio(s), wherein: a relative amount or ratio that is higher or lower than said threshold and/or reference distribution of amount(s) or ratio(s) indicates the presence of the chromosomal aneuploidy in the fetus.

* * * * *